United States Patent 7,696,334 (BIOINFORMATICALLY DETECTABLE HUMAN HERPESVIRUS 5 REGULATORY GENE) - sequence listing, part 3

SEQ ID NO: 78237 - DNA, 18 bp, Homo sapiens
gggtgtggggtgaagagg

SEQ ID NO: 78238 - DNA, 18 bp, Homo sapiens
gaggcggggtgggggagg

SEQ ID NO: 78239 - DNA, 19 bp, Homo sapiens
gggcgctggggagtgggag

SEQ ID NO: 78240 - DNA, 17 bp, Homo sapiens
agggtggggtgggaggg

SEQ ID NO: 78241 - DNA, 19 bp, Homo sapiens
gggaggcggggtggagagg

SEQ ID NO: 78242 - DNA, 22 bp, Homo sapiens
gggatgcggagctggggagagg

SEQ ID NO: 78243 - DNA, 25 bp, Homo sapiens
agggaggcggaccagggtgggaggg

SEQ ID NO: 78244 - DNA, 18 bp, Homo sapiens
gggatggggcgggggagg

SEQ ID NO: 78245 - DNA, 17 bp, Homo sapiens
ggggtgggggtggaggg

SEQ ID NO: 78246 - DNA, 18 bp, Homo sapiens
agggaagtggggaagagg

SEQ ID NO: 78247 - DNA, 18 bp, Homo sapiens
gggatggcggggtgagag

SEQ ID NO: 78248 - DNA, 20 bp, Homo sapiens
gggcccggagacaggggagg

SEQ ID NO: 78249 - DNA, 21 bp, Homo sapiens
aggggtgaggcgtaggggagg

SEQ ID NO: 78250 - DNA, 20 bp, Homo sapiens
gggggtgggggtggccgagg

SEQ ID NO: 78251 - DNA, 20 bp, Homo sapiens
ggggcgggggggcccggagg

SEQ ID NO: 78252 - DNA, 21 bp, Homo sapiens
aggaggctgaggtgggagagg

SEQ ID NO: 78253 - DNA, 19 bp, Homo sapiens
aggggcgaggggaggccgg

SEQ ID NO: 78254 - DNA, 19 bp, Homo sapiens
agggatgtaggaataagag

SEQ ID NO: 78255 - DNA, 20 bp, Homo sapiens
aggggtgcagggtgggtggg

SEQ ID NO: 78256 - DNA, 17 bp, Homo sapiens
aggggtggggtggggag

SEQ ID NO: 78257 - DNA, 20 bp, Homo sapiens
agagaggtgggtgggggagg

SEQ ID NO: 78258 - DNA, 21 bp, Homo sapiens
agggatgccccaggggagagg

SEQ ID NO: 78259 - DNA, 18 bp, Homo sapiens
gggggtggggtggggagg

SEQ ID NO: 78260 - DNA, 19 bp, Homo sapiens
aggggctcaagtgggaggg

SEQ ID NO: 78261 - DNA, 17 bp, Homo sapiens
ggggcggtggctgggag

SEQ ID NO: 78262 - DNA, 18 bp, Homo sapiens
agggagcgggggatcagg

SEQ ID NO: 78263 - DNA, 20 bp, Homo sapiens
aggcgcgcggaaactgggag

SEQ ID NO: 78264 - DNA, 16 bp, Homo sapiens
aaggagaggtgggagg

SEQ ID NO: 78265 - DNA, 20 bp, Homo sapiens
aggggcgaggggactcgagg

SEQ ID NO: 78266 - DNA, 17 bp, Homo sapiens
ggagggaggtgggagag

SEQ ID NO: 78267 - DNA, 19 bp, Homo sapiens
agggacgtgaaaagggggg

SEQ ID NO: 78268 - DNA, 21 bp, Homo sapiens
ggggtgagggggtgaagaagg

SEQ ID NO: 78269 - DNA, 20 bp, Homo sapiens
agggagtggggtgagctggg

SEQ ID NO: 78270 - DNA, 15 bp, Homo sapiens
gggacgggaggggag

SEQ ID NO: 78271 - DNA, 19 bp, Homo sapiens
gggacgcggcggggctggg

SEQ ID NO: 78272 - DNA, 22 bp, Homo sapiens
aggggcgcaggggtccccaggg

SEQ ID NO: 78273 - DNA, 21 bp, Homo sapiens
gggcggcgcggggcgcagagg

SEQ ID NO: 78274 - DNA, 18 bp, Homo sapiens
gggacgcggggcgtcggg

SEQ ID NO: 78275 - DNA, 19 bp, Homo sapiens
agggctgaggtgggggagg

SEQ ID NO: 78276 - DNA, 19 bp, Homo sapiens
agggacgcggtgactcggg

SEQ ID NO: 78277 - DNA, 21 bp, Homo sapiens
gggacttgggcaggggagagg

SEQ ID NO: 78278 - DNA, 21 bp, Homo sapiens
agggatcgtgggctccggggg

SEQ ID NO: 78279 - DNA, 21 bp, Homo sapiens
gggcgcgggcgcgcagcgagg

SEQ ID NO: 78280 - DNA, 19 bp, Homo sapiens
agggatgggggctccgagg

SEQ ID NO: 78281 - DNA, 21 bp, Homo sapiens
gggagtggggttcaggggagg

SEQ ID NO: 78282 - DNA, 19 bp, Homo sapiens
gggactggaggtgggaggg

SEQ ID NO: 78283 - DNA, 19 bp, Homo sapiens
gggccgcgggggagccggg

SEQ ID NO: 78284 - DNA, 21 bp, Homo sapiens
aggggttgggcatgggggagg

SEQ ID NO: 78285 - DNA, 22 bp, Homo sapiens
gggaagtggggtttggtggagg

SEQ ID NO: 78286 - DNA, 24 bp, Homo sapiens
ggggtgtgggggcgaaaggagagg

SEQ ID NO: 78287 - DNA, 18 bp, Homo sapiens
ggggcgggtgtgggaggg

SEQ ID NO: 78288 - DNA, 19 bp, Homo sapiens
agggatgggccaggagagg

SEQ ID NO: 78289 - DNA, 19 bp, Homo sapiens
gggagtggccgaggagagg

SEQ ID NO: 78290 - DNA, 16 bp, Homo sapiens
agggatgagtggggag

SEQ ID NO: 78291 - DNA, 23 bp, Homo sapiens
gggcagcgaggcggtgggggagg

SEQ ID NO: 78292 - DNA, 17 bp, Homo sapiens
agggagtggggtgggag

SEQ ID NO: 78293 - DNA, 18 bp, Homo sapiens
agggatggcaggggaggg

SEQ ID NO: 78294 - DNA, 15 bp, Homo sapiens
ggggcggagggggag

SEQ ID NO: 78295 - DNA, 20 bp, Homo sapiens
gggaggtggggaaggcgagg

SEQ ID NO: 78296 - DNA, 16 bp, Homo sapiens
agggactgggtgggag

SEQ ID NO: 78297 - DNA, 17 bp, Homo sapiens
agggcgcgagcggagag

SEQ ID NO: 78298 - DNA, 19 bp, Homo sapiens
agggacccgggaacagagg

SEQ ID NO: 78299 - DNA, 19 bp, Homo sapiens
aggggtgaggttagggagg

SEQ ID NO: 78300 - DNA, 19 bp, Homo sapiens
gggatgctgggggtgctgg

SEQ ID NO: 78301 - DNA, 17 bp, Homo sapiens
aggggcaggtgggaggg

SEQ ID NO: 78302 - DNA, 18 bp, Homo sapiens
aggggctgggtctgggag

SEQ ID NO: 78303 - DNA, 21 bp, Homo sapiens
ggggtgcaggagctggagagg

SEQ ID NO: 78304 - DNA, 19 bp, Homo sapiens
agggatgccggggccgagg

SEQ ID NO: 78305 - DNA, 18 bp, Homo sapiens
gggcgcgcggggagggag

SEQ ID NO: 78306 - DNA, 19 bp, Homo sapiens
gggacagtgggggcccagg

SEQ ID NO: 78307 - DNA, 19 bp, Homo sapiens
agggaggcggggaacaggg

SEQ ID NO: 78308 - DNA, 16 bp, Homo sapiens
ggggcggcggggagag

SEQ ID NO: 78309 - DNA, 18 bp, Homo sapiens
gggacggggaaggggagg

SEQ ID NO: 78310 - DNA, 16 bp, Homo sapiens
gggacgcagcggagag

SEQ ID NO: 78311 - DNA, 19 bp, Homo sapiens
agggactgtgggatgagag

SEQ ID NO: 78312 - DNA, 16 bp, Homo sapiens
gggcagggtgggaggg

SEQ ID NO: 78313 - DNA, 19 bp, Homo sapiens
agggaggcgcggggagggg

SEQ ID NO: 78314 - DNA, 19 bp, Homo sapiens
aggggtgctgggcgatggg

SEQ ID NO: 78315 - DNA, 17 bp, Homo sapiens
gggacggggtgggaggg

SEQ ID NO: 78316 - DNA, 18 bp, Homo sapiens
aggggcgatgggggtggg

SEQ ID NO: 78317 - DNA, 18 bp, Homo sapiens
gggcgcggggcgatgagg

SEQ ID NO: 78318 - DNA, 18 bp, Homo sapiens
ggggctgggacgggaggg

SEQ ID NO: 78319 - DNA, 19 bp, Homo sapiens
aggaagagggtgggagagg

SEQ ID NO: 78320 - DNA, 18 bp, Homo sapiens
aggggctgggcgcgggag

SEQ ID NO: 78321 - DNA, 18 bp, Homo sapiens
ggggtggggggggtgaag

SEQ ID NO: 78322 - DNA, 17 bp, Homo sapiens
gagacgcgagaggggag

SEQ ID NO: 78323 - DNA, 21 bp, Homo sapiens
aggagcgcgggggtcgaaagg

SEQ ID NO: 78324 - DNA, 16 bp, Homo sapiens
agggaggtgtggggag

SEQ ID NO: 78325 - DNA, 19 bp, Homo sapiens
ggggctgggggtgggaggg

SEQ ID NO: 78326 - DNA, 19 bp, Homo sapiens
aggggctgggggaattggg

SEQ ID NO: 78327 - DNA, 16 bp, Homo sapiens
gggatgagggggagag

SEQ ID NO: 78328 - DNA, 16 bp, Homo sapiens
agggtgaatgggagag

SEQ ID NO: 78329 - DNA, 23 bp, Homo sapiens
agggaggcggcaggagggagagg

SEQ ID NO: 78330 - DNA, 19 bp, Homo sapiens
gggagcggggacagacagg

SEQ ID NO: 78331 - DNA, 23 bp, Homo sapiens
gggggcgtggcttaggggagagg

SEQ ID NO: 78332 - DNA, 18 bp, Homo sapiens
gggggcggggcgggaggg

SEQ ID NO: 78333 - DNA, 19 bp, Homo sapiens
gggcgcgccgcgggggagg

SEQ ID NO: 78334 - DNA, 19 bp, Homo sapiens
ggggcggggggaggaaagg

SEQ ID NO: 78335 - DNA, 19 bp, Homo sapiens
agagacgcgggcctgagag

SEQ ID NO: 78336 - DNA, 18 bp, Homo sapiens
agggggctggtgggaggg

SEQ ID NO: 78337 - DNA, 15 bp, Homo sapiens
gggagcggaggggag

SEQ ID NO: 78338 - DNA, 19 bp, Homo sapiens
gggcgtggggagcggaggg

SEQ ID NO: 78339 - DNA, 18 bp, Homo sapiens
aggggtaggctgggaggg

SEQ ID NO: 78340 - DNA, 21 bp, Homo sapiens
aggggcctggcatgagggagg

SEQ ID NO: 78341 - DNA, 18 bp, Homo sapiens
ggggtgggggttggaggg

SEQ ID NO: 78342 - DNA, 23 bp, Homo sapiens
agggggcggggtcccaggggagg

SEQ ID NO: 78343 - DNA, 18 bp, Homo sapiens
agggagggcttgggaggg

SEQ ID NO: 78344 - DNA, 22 bp, Homo sapiens
aggggtgggggttgtggagagg

SEQ ID NO: 78345 - DNA, 16 bp, Homo sapiens
agggatggggcgagag

SEQ ID NO: 78346 - DNA, 19 bp, Homo sapiens
aggggcgtgggtgaagagg

SEQ ID NO: 78347 - DNA, 24 bp, Homo sapiens
aggggtggccagaagtgggggagg

SEQ ID NO: 78348 - DNA, 18 bp, Homo sapiens
aggggcgctggggctgag

SEQ ID NO: 78349 - DNA, 20 bp, Homo sapiens
aggggcggggcgcagggagg

SEQ ID NO: 78350 - DNA, 19 bp, Homo sapiens
gggaggtggggggagctgg

SEQ ID NO: 78351 - DNA, 16 bp, Homo sapiens
agggagggctgggagg

SEQ ID NO: 78352 - DNA, 20 bp, Homo sapiens
aggggtggggaggagagagg

SEQ ID NO: 78353 - DNA, 20 bp, Homo sapiens
gggacgggggggtgcctcgg

SEQ ID NO: 78354 - DNA, 19 bp, Homo sapiens
ggggatggaatgggagagg

SEQ ID NO: 78355 - DNA, 22 bp, Homo sapiens
ggggcgggggtggcgtgagagg

SEQ ID NO: 78356 - DNA, 24 bp, Homo sapiens
aggggcggggctcctctgggaggg

SEQ ID NO: 78357 - DNA, 19 bp, Homo sapiens
agggacttgggaacagagg

SEQ ID NO: 78358 - DNA, 18 bp, Homo sapiens
aggggccggggaggaggg

SEQ ID NO: 78359 - DNA, 25 bp, Homo sapiens
agggacgctggtgctttgggagagg

SEQ ID NO: 78360 - DNA, 20 bp, Homo sapiens
agggaggtggggtggggagg

SEQ ID NO: 78361 - DNA, 16 bp, Homo sapiens
agggggcggaggggag

SEQ ID NO: 78362 - DNA, 18 bp, Homo sapiens
aggggcgcgaccgagggg

SEQ ID NO: 78363 - DNA, 19 bp, Homo sapiens
agggatgggcttaaggagg

SEQ ID NO: 78364 - DNA, 19 bp, Homo sapiens
gggttagggggtgggaggg

SEQ ID NO: 78365 - DNA, 15 bp, Homo sapiens
gggaccggaggggag

SEQ ID NO: 78366 - DNA, 21 bp, Homo sapiens
agggtagcgtggtgggagagg

SEQ ID NO: 78367 - DNA, 20 bp, Homo sapiens
gggactcccagatgggaggg

SEQ ID NO: 78368 - DNA, 20 bp, Homo sapiens
aggagacgagagtgggaggg

SEQ ID NO: 78369 - DNA, 19 bp, Homo sapiens
aggggcggcagtggggagg

SEQ ID NO: 78370 - DNA, 22 bp, Homo sapiens
agggatgatgggggggcgggag

SEQ ID NO: 78371 - DNA, 20 bp, Homo sapiens
ggaggtaagggtgggagagg

SEQ ID NO: 78372 - DNA, 20 bp, Homo sapiens
agggttgcgggggtcgtggg

SEQ ID NO: 78373 - DNA, 21 bp, Homo sapiens
agggagggacggtgggggagg

SEQ ID NO: 78374 - DNA, 16 bp, Homo sapiens
aggggagtggtgggag

SEQ ID NO: 78375 - DNA, 20 bp, Homo sapiens
aggaggcgcgagaggagagg

SEQ ID NO: 78376 - DNA, 16 bp, Homo sapiens
ggggcgggggggtgag

SEQ ID NO: 78377 - DNA, 21 bp, Homo sapiens
gggcagtgggggaaggtgagg

SEQ ID NO: 78378 - DNA, 20 bp, Homo sapiens
gggctgctgtaggggagagg

SEQ ID NO: 78379 - DNA, 17 bp, Homo sapiens
agggtgcagtgggagag

SEQ ID NO: 78380 - DNA, 21 bp, Homo sapiens
agggatatgggtagggggagg

SEQ ID NO: 78381 - DNA, 19 bp, Homo sapiens
aggcgtgtggccagggagg

SEQ ID NO: 78382 - DNA, 16 bp, Homo sapiens
gggcgcgggatacgag

SEQ ID NO: 78383 - DNA, 19 bp, Homo sapiens
gggcggcgcggcgggaggg

SEQ ID NO: 78384 - DNA, 20 bp, Homo sapiens
aggggcgggggtcgtcgagg

SEQ ID NO: 78385 - DNA, 22 bp, Homo sapiens
gggacacgagacacgggggagg

SEQ ID NO: 78386 - DNA, 19 bp, Homo sapiens
agggatgcggggcttggag

SEQ ID NO: 78387 - DNA, 19 bp, Homo sapiens
gggatgaggatcgggaggg

SEQ ID NO: 78388 - DNA, 18 bp, Homo sapiens
gggcggggggtgctggag

SEQ ID NO: 78389 - DNA, 27 bp, Homo sapiens
gggatgcagaggttaggtgggagaggc

SEQ ID NO: 78390 - DNA, 20 bp, Homo sapiens
aggggtgcggagcctgggag

SEQ ID NO: 78391 - DNA, 19 bp, Homo sapiens
gggaccggaggagggaggg

SEQ ID NO: 78392 - DNA, 21 bp, Homo sapiens
agggaggtgggagcggggagg

SEQ ID NO: 78393 - DNA, 17 bp, Homo sapiens
gggagcgggggtgccag

SEQ ID NO: 78394 - DNA, 19 bp, Homo sapiens
ggggcggatcgccgggagg

SEQ ID NO: 78395 - DNA, 22 bp, Homo sapiens
gggggtggggggtggggagagg

SEQ ID NO: 78396 - DNA, 18 bp, Homo sapiens
agggacgcgaggagggag

SEQ ID NO: 78397 - DNA, 20 bp, Homo sapiens
aggggcggcccgcggggagg

SEQ ID NO: 78398 - DNA, 19 bp, Homo sapiens
gggggagaggtgggggagg

SEQ ID NO: 78399 - DNA, 18 bp, Homo sapiens
aggggtggcgggggcggg

SEQ ID NO: 78400 - DNA, 20 bp, Homo sapiens
agggtgacaaggtgggaggg

SEQ ID NO: 78401 - DNA, 23 bp, Homo sapiens
aggggcttggggccggggggagg

SEQ ID NO: 78402 - DNA, 19 bp, Homo sapiens
ggggcatggggcccaggag

SEQ ID NO: 78403 - DNA, 18 bp, Homo sapiens
agggctgcgggggctggg

SEQ ID NO: 78404 - DNA, 19 bp, Homo sapiens
gggtgtggggcgggagagg

SEQ ID NO: 78405 - DNA, 22 bp, Homo sapiens
aggggcgcagaggcgggagagg

SEQ ID NO: 78406 - DNA, 18 bp, Homo sapiens
gggcgcggggggcgcgag

SEQ ID NO: 78407 - DNA, 20 bp, Homo sapiens
aggggcgcggggggcgcggg

SEQ ID NO: 78408 - DNA, 18 bp, Homo sapiens
gggcgcgagggtctcagg

SEQ ID NO: 78409 - DNA, 22 bp, Homo sapiens
agggggtgggagacaggagagg

SEQ ID NO: 78410 - DNA, 20 bp, Homo sapiens
aggcggcgcgggcggggagg

SEQ ID NO: 78411 - DNA, 18 bp, Homo sapiens
agggcagggtgggggagg

SEQ ID NO: 78412 - DNA, 20 bp, Homo sapiens
ggggggcgggtgttgagagg

SEQ ID NO: 78413 - DNA, 16 bp, Homo sapiens
aggggcggctggggag

SEQ ID NO: 78414 - DNA, 20 bp, Homo sapiens
agggagcgggggtggggagg

SEQ ID NO: 78415 - DNA, 22 bp, Homo sapiens
ggggcggcggccgcagggaggg

SEQ ID NO: 78416 - DNA, 18 bp, Homo sapiens
gggaaggagtgggggagg

SEQ ID NO: 78417 - DNA, 22 bp, Homo sapiens
agggacagtgtccatgggaggg

SEQ ID NO: 78418 - DNA, 18 bp, Homo sapiens
gggtgcacaggggagagg

SEQ ID NO: 78419 - DNA, 23 bp, Homo sapiens
gggatgtggaatggtgggggagg

SEQ ID NO: 78420 - DNA, 16 bp, Homo sapiens
aggggcagtgggggag

SEQ ID NO: 78421 - DNA, 18 bp, Homo sapiens
agggggcggagaagggag

SEQ ID NO: 78422 - DNA, 21 bp, Homo sapiens
aggggcgcgggggagctcggg

SEQ ID NO: 78423 - DNA, 18 bp, Homo sapiens
gcggcgcggtgagagagg

SEQ ID NO: 78424 - DNA, 19 bp, Homo sapiens
agggagtggggtgggaggg

SEQ ID NO: 78425 - DNA, 19 bp, Homo sapiens
aggaggtggctgggagagg

SEQ ID NO: 78426 - DNA, 20 bp, Homo sapiens
aggggtgggggctggggagg

SEQ ID NO: 78427 - DNA, 23 bp, Homo sapiens
gggcgtgtgcaaaaggggggagg

SEQ ID NO: 78428 - DNA, 18 bp, Homo sapiens
ggctgggggtgggggagg

SEQ ID NO: 78429 - DNA, 18 bp, Homo sapiens
aggggcgtgtgcaaaagg

SEQ ID NO: 78430 - DNA, 19 bp, Homo sapiens
agggggcgacgtggggagg

SEQ ID NO: 78431 - DNA, 16 bp, Homo sapiens
aggggggtgtggggag

SEQ ID NO: 78432 - DNA, 24 bp, Homo sapiens
aggggcagggctgggtgggagagg

SEQ ID NO: 78433 - DNA, 19 bp, Homo sapiens
gggaggcgaattggagagg

SEQ ID NO: 78434 - DNA, 15 bp, Homo sapiens
ggggcgaggcgggag

SEQ ID NO: 78435 - DNA, 21 bp, Homo sapiens
ggggcctggagtggggggagg

SEQ ID NO: 78436 - DNA, 21 bp, Homo sapiens
gggcagtgggatggtgagagg

SEQ ID NO: 78437 - DNA, 19 bp, Homo sapiens
aggacgtgggagaaaggag

SEQ ID NO: 78438 - DNA, 22 bp, Homo sapiens
agggatgtggggaggatggagg

SEQ ID NO: 78439 - DNA, 22 bp, Homo sapiens
aagtcggcgggggtgggagagg

SEQ ID NO: 78440 - DNA, 19 bp, Homo sapiens
ggatgcggggcgggggagg

SEQ ID NO: 78441 - DNA, 19 bp, Homo sapiens
aggggcggctaccggaggg

SEQ ID NO: 78442 - DNA, 22 bp, Homo sapiens
gggatgtggggagtgagagagg

SEQ ID NO: 78443 - DNA, 20 bp, Homo sapiens
aggggcgtagggcaaacggg

SEQ ID NO: 78444 - DNA, 19 bp, Homo sapiens
agggagaccctgggagggg

SEQ ID NO: 78445 - DNA, 21 bp, Homo sapiens
ggagggcagcagtgggggagg

SEQ ID NO: 78446 - DNA, 18 bp, Homo sapiens
gagagcggggtgggaggg

SEQ ID NO: 78447 - DNA, 21 bp, Homo sapiens
gggaggagagggtgggagagg

SEQ ID NO: 78448 - DNA, 19 bp, Homo sapiens
aagaagggggtgggggagg

SEQ ID NO: 78449 - DNA, 20 bp, Homo sapiens
aggggctgggggtggcgagg

SEQ ID NO: 78450 - DNA, 16 bp, Homo sapiens
ggggcagcggcgggag

SEQ ID NO: 78451 - DNA, 17 bp, Homo sapiens
ggggcgcggggaaggag

SEQ ID NO: 78452 - DNA, 18 bp, Homo sapiens
gggacgggggggctcagg

SEQ ID NO: 78453 - DNA, 16 bp, Homo sapiens
aggggcggggcgggag

SEQ ID NO: 78454 - DNA, 22 bp, Homo sapiens
gggctggtgaggcgtgggaggg

SEQ ID NO: 78455 - DNA, 19 bp, Homo sapiens
gggacttgggggtgacaag

SEQ ID NO: 78456 - DNA, 21 bp, Homo sapiens
agggaggcgggcatgggaggg

SEQ ID NO: 78457 - DNA, 22 bp, Homo sapiens
aggggggcgggcggtgggaggg

SEQ ID NO: 78458 - DNA, 21 bp, Homo sapiens
aggcggcaagagtgggggagg

SEQ ID NO: 78459 - DNA, 19 bp, Homo sapiens
ggggcgcggggggctcggg

SEQ ID NO: 78460 - DNA, 20 bp, Homo sapiens
agggattggggcaggggagg

SEQ ID NO: 78461 - DNA, 17 bp, Homo sapiens
aggggtgggggcgggag

SEQ ID NO: 78462 - DNA, 18 bp, Homo sapiens
ggggcgcggggaggaggg

SEQ ID NO: 78463 - DNA, 19 bp, Homo sapiens
gggatgaggatgggagagg

SEQ ID NO: 78464 - DNA, 21 bp, Homo sapiens
agggagtggggagacaagagg

SEQ ID NO: 78465 - DNA, 18 bp, Homo sapiens
gggcgcgggaggcgagag

SEQ ID NO: 78466 - DNA, 16 bp, Homo sapiens
agggcaggtgggagag

SEQ ID NO: 78467 - DNA, 21 bp, Homo sapiens
gggagcgggcaacacggaggg

SEQ ID NO: 78468 - DNA, 23 bp, Homo sapiens
agggtgcttgaaggtgggggagg

SEQ ID NO: 78469 - DNA, 19 bp, Homo sapiens
gggcgctgggcgagaaagg

SEQ ID NO: 78470 - DNA, 20 bp, Homo sapiens
aggggttggaaatgggaggg

SEQ ID NO: 78471 - DNA, 15 bp, Homo sapiens
ggggcgaagggggag

SEQ ID NO: 78472 - DNA, 20 bp, Homo sapiens
ggggtgggggctgagggagg

SEQ ID NO: 78473 - DNA, 19 bp, Homo sapiens
agggcgcggggggtcaggg

SEQ ID NO: 78474 - DNA, 20 bp, Homo sapiens
gggacgggcacgtggagagg

SEQ ID NO: 78475 - DNA, 18 bp, Homo sapiens
gggaggtgggagtgggag

SEQ ID NO: 78476 - DNA, 20 bp, Homo sapiens
gggatgtgagggtggaaggg

SEQ ID NO: 78477 - DNA, 22 bp, Homo sapiens
agagagtggggggtgggggagg

SEQ ID NO: 78478 - DNA, 20 bp, Homo sapiens
aggggcgggaccctcgggag

SEQ ID NO: 78479 - DNA, 19 bp, Homo sapiens
agggagtgggatgaaaggg

SEQ ID NO: 78480 - DNA, 17 bp, Homo sapiens
aggggccgcggtgggag

SEQ ID NO: 78481 - DNA, 20 bp, Homo sapiens
gggaaggctcctgggagagg

SEQ ID NO: 78482 - DNA, 23 bp, Homo sapiens
ggaggcggggacaggtgggaggg

SEQ ID NO: 78483 - DNA, 18 bp, Homo sapiens
ggcggggggtgggggagg

SEQ ID NO: 78484 - DNA, 20 bp, Homo sapiens
gggtgacgtggccagagagg

SEQ ID NO: 78485 - DNA, 22 bp, Homo sapiens
agggaggcgggcagtcggaggg

SEQ ID NO: 78486 - DNA, 21 bp, Homo sapiens
aggatgtggggacagcagagg

SEQ ID NO: 78487 - DNA, 23 bp, Homo sapiens
agggacgccagctgtgggggggg

SEQ ID NO: 78488 - DNA, 16 bp, Homo sapiens
agggacgggtggggag

SEQ ID NO: 78489 - DNA, 22 bp, Homo sapiens
agggatgcggagtggggagagg

SEQ ID NO: 78490 - DNA, 20 bp, Homo sapiens
gggggtgggaggtggggagg

SEQ ID NO: 78491 - DNA, 21 bp, Homo sapiens
gggcgcgggccccgggggagg

SEQ ID NO: 78492 - DNA, 20 bp, Homo sapiens
aggggtgcaggatgaggagg

SEQ ID NO: 78493 - DNA, 20 bp, Homo sapiens
aggggctggaatgggggagg

SEQ ID NO: 78494 - DNA, 19 bp, Homo sapiens
gggtgcgcgcggagagagg

SEQ ID NO: 78495 - DNA, 21 bp, Homo sapiens
agaggtgtggagggggagagg

SEQ ID NO: 78496 - DNA, 19 bp, Homo sapiens
gggagcggggacttgggag

SEQ ID NO: 78497 - DNA, 18 bp, Homo sapiens
agggatcgggggtgctgg

SEQ ID NO: 78498 - DNA, 19 bp, Homo sapiens
aggggcggggggtgatggg

SEQ ID NO: 78499 - DNA, 17 bp, Homo sapiens
agggggcgggtcgggag

SEQ ID NO: 78500 - DNA, 17 bp, Homo sapiens
aggacgcggtcggggag

SEQ ID NO: 78501 - DNA, 21 bp, Homo sapiens
agggatggggatgtatggagg

SEQ ID NO: 78502 - DNA, 19 bp, Homo sapiens
agggatgtaggggaagagg

SEQ ID NO: 78503 - DNA, 22 bp, Homo sapiens
aggggtgggtagaaaggagagg

SEQ ID NO: 78504 - DNA, 18 bp, Homo sapiens
ggcgacgcggcaagtgag

SEQ ID NO: 78505 - DNA, 21 bp, Homo sapiens
agggaggcggccacacgggag

SEQ ID NO: 78506 - DNA, 21 bp, Homo sapiens
ggggtgcgggggtgggggtgg

SEQ ID NO: 78507 - DNA, 18 bp, Homo sapiens
aggggcgctggggaaagg

SEQ ID NO: 78508 - DNA, 22 bp, Homo sapiens
agggatctggaggagggagagg

SEQ ID NO: 78509 - DNA, 20 bp, Homo sapiens
gggagcgggagacagggagg

SEQ ID NO: 78510 - DNA, 22 bp, Homo sapiens
agggatggggggccgggggagg

SEQ ID NO: 78511 - DNA, 20 bp, Homo sapiens
aggggcgcgagggggccagg

SEQ ID NO: 78512 - DNA, 21 bp, Homo sapiens
gggcctaaggggtgggggagg

SEQ ID NO: 78513 - DNA, 20 bp, Homo sapiens
agggagtgggggtgaccagg

SEQ ID NO: 78514 - DNA, 25 bp, Homo sapiens
ggtgataaagggggtgggggaggcc

SEQ ID NO: 78515 - DNA, 18 bp, Homo sapiens
aggagatgggtgggaggg

SEQ ID NO: 78516 - DNA, 17 bp, Homo sapiens
aggagcgcgggttggag

SEQ ID NO: 78517 - DNA, 18 bp, Homo sapiens
gggatgagggaagagagg

SEQ ID NO: 78518 - DNA, 18 bp, Homo sapiens
gcggggtgcgggcagaag

SEQ ID NO: 78519 - DNA, 17 bp, Homo sapiens
gggcgcaggaattggag

SEQ ID NO: 78520 - DNA, 18 bp, Homo sapiens
ggggtgggggtggggagg

SEQ ID NO: 78521 - DNA, 19 bp, Homo sapiens
aggggctggggaggaaggg

SEQ ID NO: 78522 - DNA, 18 bp, Homo sapiens
gggattgcaccggagagg

SEQ ID NO: 78523 - DNA, 18 bp, Homo sapiens
aggtgactggtgggaggg

SEQ ID NO: 78524 - DNA, 18 bp, Homo sapiens
gggagttgaatgggaggg

SEQ ID NO: 78525 - DNA, 22 bp, Homo sapiens
agggatggggggtggcaagagg

SEQ ID NO: 78526 - DNA, 17 bp, Homo sapiens
gggacggggagacggag

SEQ ID NO: 78527 - DNA, 20 bp, Homo sapiens
gggacgaggggcactacggg

SEQ ID NO: 78528 - DNA, 19 bp, Homo sapiens
aggggcgggggcgccgagg

SEQ ID NO: 78529 - DNA, 19 bp, Homo sapiens
agggactgggccgggaggg

SEQ ID NO: 78530 - DNA, 20 bp, Homo sapiens
ggggtggggtggtggggagg

SEQ ID NO: 78531 - DNA, 17 bp, Homo sapiens
ggacgcggggaccgagg

SEQ ID NO: 78532 - DNA, 22 bp, Homo sapiens
agggagtggggtggcccggagg

SEQ ID NO: 78533 - DNA, 20 bp, Homo sapiens
agggatggggctgcggaggg

SEQ ID NO: 78534 - DNA, 17 bp, Homo sapiens
agggacctggggggaag

SEQ ID NO: 78535 - DNA, 16 bp, Homo sapiens
ggggagggtgggagag

SEQ ID NO: 78536 - DNA, 23 bp, Homo sapiens
agggggtgggggtagaccagagg

SEQ ID NO: 78537 - DNA, 23 bp, Homo sapiens
aggggcgaggggacctgtagagg

SEQ ID NO: 78538 - DNA, 18 bp, Homo sapiens
gggagcgggctggggagg

SEQ ID NO: 78539 - DNA, 21 bp, Homo sapiens
gggcgcgcggggggctctcgg

SEQ ID NO: 78540 - DNA, 20 bp, Homo sapiens
gggcgtgggaggtggggagg

SEQ ID NO: 78541 - DNA, 22 bp, Homo sapiens
gagcagtagggggtgggggagg

SEQ ID NO: 78542 - DNA, 21 bp, Homo sapiens
gggcggggccgggtgggaggg

SEQ ID NO: 78543 - DNA, 17 bp, Homo sapiens
ggagggtagtgggagag

SEQ ID NO: 78544 - DNA, 16 bp, Homo sapiens
gggcgcggggcagagg

SEQ ID NO: 78545 - DNA, 17 bp, Homo sapiens
agggagcggggaaggag

SEQ ID NO: 78546 - DNA, 19 bp, Homo sapiens
gggaagcgggaaggagagg

SEQ ID NO: 78547 - DNA, 20 bp, Homo sapiens
agggaggcgggaggcgggag

SEQ ID NO: 78548 - DNA, 22 bp, Homo sapiens
agggaagagaaagtgggagagg

SEQ ID NO: 78549 - DNA, 21 bp, Homo sapiens
aggggcgtggggctgcccggg

SEQ ID NO: 78550 - DNA, 17 bp, Homo sapiens
agggaaaggtgggaggg

SEQ ID NO: 78551 - DNA, 22 bp, Homo sapiens
gggcctggggcggatggggagg

SEQ ID NO: 78552 - DNA, 22 bp, Homo sapiens
agggggcggggaagaaaagagg

SEQ ID NO: 78553 - DNA, 20 bp, Homo sapiens
aggggctgggggaagcgagg

SEQ ID NO: 78554 - DNA, 22 bp, Homo sapiens
gggaagaaggaaggtgggaggg

SEQ ID NO: 78555 - DNA, 18 bp, Homo sapiens
aggggagggtgggagagg

SEQ ID NO: 78556 - DNA, 19 bp, Homo sapiens
aggagtgtggtgggagagg

SEQ ID NO: 78557 - DNA, 17 bp, Homo sapiens
aggagcgtgggttggag

SEQ ID NO: 78558 - DNA, 15 bp, Homo sapiens
agggacgggcgggag

SEQ ID NO: 78559 - DNA, 20 bp, Homo sapiens
gggacagcgaaggggagagg

SEQ ID NO: 78560 - DNA, 22 bp, Homo sapiens
aggtgatggaaagtgggggagg

SEQ ID NO: 78561 - DNA, 21 bp, Homo sapiens
aggggttggggcaggcagagg

SEQ ID NO: 78562 - DNA, 19 bp, Homo sapiens
aggggttggggtggggagg

SEQ ID NO: 78563 - DNA, 18 bp, Homo sapiens
ggggctgggcggcgggag

SEQ ID NO: 78564 - DNA, 21 bp, Homo sapiens
agggactggggagagaagaga

SEQ ID NO: 78565 - DNA, 24 bp, Homo sapiens
gggatgggggtgggtggggggagg

SEQ ID NO: 78566 - DNA, 22 bp, Homo sapiens
aggcatgtggaggtgggggagg

SEQ ID NO: 78567 - DNA, 18 bp, Homo sapiens
aggggtgcgaggggtggg

SEQ ID NO: 78568 - DNA, 20 bp, Homo sapiens
agggaagtggggtagaaggg

SEQ ID NO: 78569 - DNA, 21 bp, Homo sapiens
agaggcaagcaggtgggaggg

SEQ ID NO: 78570 - DNA, 22 bp, Homo sapiens
gggcgggcagggttgggggagg

SEQ ID NO: 78571 - DNA, 24 bp, Homo sapiens
agggcagaaggtggggtgggaggg

SEQ ID NO: 78572 - DNA, 20 bp, Homo sapiens
agggcctgaggtgggagagg

SEQ ID NO: 78573 - DNA, 19 bp, Homo sapiens
aggggcgagagtggggagg

SEQ ID NO: 78574 - DNA, 18 bp, Homo sapiens
agggtgtggggagagagg

SEQ ID NO: 78575 - DNA, 18 bp, Homo sapiens
agggagtgggagctggag

SEQ ID NO: 78576 - DNA, 21 bp, Homo sapiens
gggacgcgggctccggagagg

SEQ ID NO: 78577 - DNA, 20 bp, Homo sapiens
aggggcgcgcgagagagagg

SEQ ID NO: 78578 - DNA, 22 bp, Homo sapiens
aggcatgtggggtgaggagagg

SEQ ID NO: 78579 - DNA, 17 bp, Homo sapiens
gggggggtgcgggagag

SEQ ID NO: 78580 - DNA, 17 bp, Homo sapiens
agggagcgagaggggag

SEQ ID NO: 78581 - DNA, 16 bp, Homo sapiens
aggggggatgggggag

SEQ ID NO: 78582 - DNA, 23 bp, Homo sapiens
agggacagcggggggacaacagg

SEQ ID NO: 78583 - DNA, 20 bp, Homo sapiens
aggggtgggggaagaagagg

SEQ ID NO: 78584 - DNA, 20 bp, Homo sapiens
agaggcgtggctgagggagg

SEQ ID NO: 78585 - DNA, 19 bp, Homo sapiens
agggacgacgggctggggg

SEQ ID NO: 78586 - DNA, 20 bp, Homo sapiens
gggggcggggcctgggaggg

SEQ ID NO: 78587 - DNA, 22 bp, Homo sapiens
agggcagagaggggtgggaggg

SEQ ID NO: 78588 - DNA, 20 bp, Homo sapiens
gggatgctccatgggagagg

SEQ ID NO: 78589 - DNA, 17 bp, Homo sapiens
gggagcgggggacgagg

SEQ ID NO: 78590 - DNA, 20 bp, Homo sapiens
aggggcgcggcggggagagg

SEQ ID NO: 78591 - DNA, 21 bp, Homo sapiens
agggaagtgctcagaggggag

SEQ ID NO: 78592 - DNA, 18 bp, Homo sapiens
agggacgcggaggagagg

SEQ ID NO: 78593 - DNA, 17 bp, Homo sapiens
ggtgaaaggtgggggag

SEQ ID NO: 78594 - DNA, 17 bp, Homo sapiens
ggggcgggggcctggag

SEQ ID NO: 78595 - DNA, 21 bp, Homo sapiens
agggtcgtggggggcagcggg

SEQ ID NO: 78596 - DNA, 19 bp, Homo sapiens
aggacggatgtgggggagg

SEQ ID NO: 78597 - DNA, 19 bp, Homo sapiens
aggacagcggtgggagagg

SEQ ID NO: 78598 - DNA, 23 bp, Homo sapiens
gagatgcggggattgttgagagg

SEQ ID NO: 78599 - DNA, 20 bp, Homo sapiens
aggcacgcggggcggggagg

SEQ ID NO: 78600 - DNA, 16 bp, Homo sapiens
agggatgagggaggag

SEQ ID NO: 78601 - DNA, 18 bp, Homo sapiens
gggacagttggggagagg

SEQ ID NO: 78602 - DNA, 20 bp, Homo sapiens
agggatgaggagcaggaggg

SEQ ID NO: 78603 - DNA, 22 bp, Homo sapiens
gggtcgtgggggtgggtggagg

SEQ ID NO: 78604 - DNA, 18 bp, Homo sapiens
agggacttggggggcggg

SEQ ID NO: 78605 - DNA, 20 bp, Homo sapiens
ggaggtgggctgtgggaggg

SEQ ID NO: 78606 - DNA, 21 bp, Homo sapiens
gggatgggtctgatggggagg

SEQ ID NO: 78607 - DNA, 20 bp, Homo sapiens
aggggcgggtaggggggagg

SEQ ID NO: 78608 - DNA, 21 bp, Homo sapiens
aggggtggggggtagtagagg

SEQ ID NO: 78609 - DNA, 24 bp, Homo sapiens
aggagcgcggagagccgggggagg

SEQ ID NO: 78610 - DNA, 16 bp, Homo sapiens
aggggcggagggagag

SEQ ID NO: 78611 - DNA, 19 bp, Homo sapiens
aggggcctgggggctcagg

SEQ ID NO: 78612 - DNA, 18 bp, Homo sapiens
gggcaccaggtgggaggg

SEQ ID NO: 78613 - DNA, 16 bp, Homo sapiens
gggacaggtgggaggg

SEQ ID NO: 78614 - DNA, 17 bp, Homo sapiens
ggggcgcgcggggagag

SEQ ID NO: 78615 - DNA, 17 bp, Homo sapiens
agggatgggagggagag

SEQ ID NO: 78616 - DNA, 21 bp, Homo sapiens
agggtagaagggtgggagagg

SEQ ID NO: 78617 - DNA, 16 bp, Homo sapiens
gggaagcgggtaggag

SEQ ID NO: 78618 - DNA, 18 bp, Homo sapiens
gggggcagtgtgggaggg

SEQ ID NO: 78619 - DNA, 19 bp, Homo sapiens
aggaaaagggtgggggagg

SEQ ID NO: 78620 - DNA, 22 bp, Homo sapiens
agggagtggggggaccaagagg

SEQ ID NO: 78621 - DNA, 20 bp, Homo sapiens
aggggcgggggagggggagg

SEQ ID NO: 78622 - DNA, 18 bp, Homo sapiens
gggatatggataggaggg

SEQ ID NO: 78623 - DNA, 19 bp, Homo sapiens
aggggcccgggcggggagg

SEQ ID NO: 78624 - DNA, 22 bp, Homo sapiens
aggagtgcggggcggggggagg

SEQ ID NO: 78625 - DNA, 16 bp, Homo sapiens
gggggcgggcggggag

SEQ ID NO: 78626 - DNA, 22 bp, Homo sapiens
agggaggtgggagcaagagagg

SEQ ID NO: 78627 - DNA, 19 bp, Homo sapiens
aggggcggtccaggagagg

SEQ ID NO: 78628 - DNA, 20 bp, Homo sapiens
gggatggggtaccagagagg

SEQ ID NO: 78629 - DNA, 18 bp, Homo sapiens
gggaggatgtgggggagg

SEQ ID NO: 78630 - DNA, 22 bp, Homo sapiens
ggggtcggggcaaggggagagg

SEQ ID NO: 78631 - DNA, 18 bp, Homo sapiens
ggggcgagaacggggagg

SEQ ID NO: 78632 - DNA, 20 bp, Homo sapiens
ggggctgtggctgtggaggg

SEQ ID NO: 78633 - DNA, 16 bp, Homo sapiens
gggaagtgggggagag

SEQ ID NO: 78634 - DNA, 21 bp, Homo sapiens
agggggaggtggtgggagagg

SEQ ID NO: 78635 - DNA, 21 bp, Homo sapiens
gggagcgcgggggtcgccggg

SEQ ID NO: 78636 - DNA, 22 bp, Homo sapiens
agggattgggggtagctccagg

SEQ ID NO: 78637 - DNA, 23 bp, Homo sapiens
ggggtggggggcgtggggggagg

SEQ ID NO: 78638 - DNA, 18 bp, Homo sapiens
agagggtgagtgggaggg

SEQ ID NO: 78639 - DNA, 20 bp, Homo sapiens
aggggcgtggggagagccgg

SEQ ID NO: 78640 - DNA, 15 bp, Homo sapiens
ggggcgagggaagag

SEQ ID NO: 78641 - DNA, 20 bp, Homo sapiens
agggaccgggaacgggaggg

SEQ ID NO: 78642 - DNA, 18 bp, Homo sapiens
aggggcggggggggaggg

SEQ ID NO: 78643 - DNA, 19 bp, Homo sapiens
gggacgcgggcgaagcgga

SEQ ID NO: 78644 - DNA, 24 bp, Homo sapiens
gggtggtgggggtgatgtgagagg

SEQ ID NO: 78645 - DNA, 21 bp, Homo sapiens
ggggcgcggggggcgcacggg

SEQ ID NO: 78646 - DNA, 20 bp, Homo sapiens
agggacctggggtgaggagg

SEQ ID NO: 78647 - DNA, 18 bp, Homo sapiens
aggaacgcgcggggaggg

SEQ ID NO: 78648 - DNA, 18 bp, Homo sapiens
gggagtggggaagagagg

SEQ ID NO: 78649 - DNA, 19 bp, Homo sapiens
agggaccgggacggggagg

SEQ ID NO: 78650 - DNA, 18 bp, Homo sapiens
agggaacgtggctgggag

SEQ ID NO: 78651 - DNA, 17 bp, Homo sapiens
gggcgcggtgaggggag

SEQ ID NO: 78652 - DNA, 18 bp, Homo sapiens
aggggcggggagccaggg

SEQ ID NO: 78653 - DNA, 18 bp, Homo sapiens
gggacgccggggcacagg

SEQ ID NO: 78654 - DNA, 24 bp, Homo sapiens
aggggggtgggggtggtggagagg

SEQ ID NO: 78655 - DNA, 20 bp, Homo sapiens
agggaggtgggggggacagg

SEQ ID NO: 78656 - DNA, 20 bp, Homo sapiens
aggggcacggccgggggagg

SEQ ID NO: 78657 - DNA, 18 bp, Homo sapiens
gggacgcggcgggtgtgg

SEQ ID NO: 78658 - DNA, 22 bp, Homo sapiens
aggggggtgggggtgggggtgg

SEQ ID NO: 78659 - DNA, 22 bp, Homo sapiens
aggtgtgcgggggtgaaggagg

SEQ ID NO: 78660 - DNA, 19 bp, Homo sapiens
gggactgggcgccggaggg

SEQ ID NO: 78661 - DNA, 18 bp, Homo sapiens
aggggcccggggcgagag

SEQ ID NO: 78662 - DNA, 21 bp, Homo sapiens
gggaagtgggggtaagggagg

SEQ ID NO: 78663 - DNA, 16 bp, Homo sapiens
gggactggggcagagg

SEQ ID NO: 78664 - DNA, 17 bp, Homo sapiens
ggggcggtgcggggagg

SEQ ID NO: 78665 - DNA, 20 bp, Homo sapiens
agggctgctgatgggagagg

SEQ ID NO: 78666 - DNA, 22 bp, Homo sapiens
aggggtggggggagcaggaggg

SEQ ID NO: 78667 - DNA, 20 bp, Homo sapiens
gggtgcgggggtgggctggg

SEQ ID NO: 78668 - DNA, 18 bp, Homo sapiens
gggacgcggggatgtaag

SEQ ID NO: 78669 - DNA, 23 bp, Homo sapiens
agggaggcgggtcctcggggagg

SEQ ID NO: 78670 - DNA, 18 bp, Homo sapiens
agggactggcaggagggg

SEQ ID NO: 78671 - DNA, 16 bp, Homo sapiens
gggaagcgggaaggag

SEQ ID NO: 78672 - DNA, 18 bp, Homo sapiens
gggacagcctgggagagg

SEQ ID NO: 78673 - DNA, 22 bp, Homo sapiens
agggagtgggggcggtgagagg

SEQ ID NO: 78674 - DNA, 18 bp, Homo sapiens
ggggctggggtgtcaggg

SEQ ID NO: 78675 - DNA, 25 bp, Homo sapiens
ggggtgcagggtggactgggggagg

SEQ ID NO: 78676 - DNA, 19 bp, Homo sapiens
aggggccggggaggagagg

SEQ ID NO: 78677 - DNA, 19 bp, Homo sapiens
ggggctggggatggggagg

SEQ ID NO: 78678 - DNA, 22 bp, Homo sapiens
aggggctgggggccaggggagg

SEQ ID NO: 78679 - DNA, 20 bp, Homo sapiens
ggtgcgcggtgacggggagg

SEQ ID NO: 78680 - DNA, 16 bp, Homo sapiens
ggggcgcgggggggag

SEQ ID NO: 78681 - DNA, 20 bp, Homo sapiens
aggggtgtgagggacagagg

SEQ ID NO: 78682 - DNA, 20 bp, Homo sapiens
agggatgggaagaggggagg

SEQ ID NO: 78683 - DNA, 18 bp, Homo sapiens
aggggtggggggcgggag

SEQ ID NO: 78684 - DNA, 20 bp, Homo sapiens
aggggttggggtggaagagg

SEQ ID NO: 78685 - DNA, 18 bp, Homo sapiens
gggattggccaggagagg

SEQ ID NO: 78686 - DNA, 16 bp, Homo sapiens
ggggctggggtaggag

SEQ ID NO: 78687 - DNA, 25 bp, Homo sapiens
aggggggcgggggccagcgggaggg

SEQ ID NO: 78688 - DNA, 16 bp, Homo sapiens
agggatgaggtgggag

SEQ ID NO: 78689 - DNA, 17 bp, Homo sapiens
gggaggtgaggggaggg

SEQ ID NO: 78690 - DNA, 21 bp, Homo sapiens
gggagtgcgggggtcgggagg

SEQ ID NO: 78691 - DNA, 19 bp, Homo sapiens
agggacgggcccggggagg

SEQ ID NO: 78692 - DNA, 23 bp, Homo sapiens
agggacgtggcggcctttagagg

SEQ ID NO: 78693 - DNA, 19 bp, Homo sapiens
agggccctagtgggagagg

SEQ ID NO: 78694 - DNA, 21 bp, Homo sapiens
gggctcgggctcgccgggagg

SEQ ID NO: 78695 - DNA, 18 bp, Homo sapiens
agggcgcgggagcgggag

SEQ ID NO: 78696 - DNA, 20 bp, Homo sapiens
gggatgggggggtagagagg

SEQ ID NO: 78697 - DNA, 19 bp, Homo sapiens
gggcgtgggggtaaggagg

SEQ ID NO: 78698 - DNA, 20 bp, Homo sapiens
aggggtgggggaggcagagg

SEQ ID NO: 78699 - DNA, 21 bp, Homo sapiens
aaggagcaaggggtgggaggg

SEQ ID NO: 78700 - DNA, 18 bp, Homo sapiens
agggacagcagggagggg

SEQ ID NO: 78701 - DNA, 18 bp, Homo sapiens
ggtgcgggagccggaggg

SEQ ID NO: 78702 - DNA, 20 bp, Homo sapiens
gggacggcgggggtcccggg

SEQ ID NO: 78703 - DNA, 19 bp, Homo sapiens
gggaggaatgtgggagagg

SEQ ID NO: 78704 - DNA, 18 bp, Homo sapiens
gggacgccggccgcggag

SEQ ID NO: 78705 - DNA, 24 bp, Homo sapiens
aggggtgttggggtttgtgaaggg

SEQ ID NO: 78706 - DNA, 22 bp, Homo sapiens
gggacgggggtgcctagagagg

SEQ ID NO: 78707 - DNA, 21 bp, Homo sapiens
agggggcgggcggcggagagg

SEQ ID NO: 78708 - DNA, 18 bp, Homo sapiens
agggggcaggtgggaggg

SEQ ID NO: 78709 - DNA, 19 bp, Homo sapiens
aggggccggggccgaaggg

SEQ ID NO: 78710 - DNA, 16 bp, Homo sapiens
ggtgcgggggtagagg

SEQ ID NO: 78711 - DNA, 18 bp, Homo sapiens
gggagtggggtggggagg

SEQ ID NO: 78712 - DNA, 19 bp, Homo sapiens
agggaagtgatgggagagg

SEQ ID NO: 78713 - DNA, 19 bp, Homo sapiens
agggaaggcctgggggagg

SEQ ID NO: 78714 - DNA, 20 bp, Homo sapiens
agggaagtgggcaggagaga

SEQ ID NO: 78715 - DNA, 19 bp, Homo sapiens
ggggtggaggtgggagagg

SEQ ID NO: 78716 - DNA, 19 bp, Homo sapiens
gggcggtgggggtggtggg

SEQ ID NO: 78717 - DNA, 18 bp, Homo sapiens
ggggtgcaggagagggag

SEQ ID NO: 78718 - DNA, 17 bp, Homo sapiens
aggggagattgggagag

SEQ ID NO: 78719 - DNA, 19 bp, Homo sapiens
aggacgtggggtgaggagg

SEQ ID NO: 78720 - DNA, 22 bp, Homo sapiens
agggagtgttgggtgggagagg

SEQ ID NO: 78721 - DNA, 22 bp, Homo sapiens
aggggtgaggtgaagggagagg

SEQ ID NO: 78722 - DNA, 17 bp, Homo sapiens
aggggggtgcgggagag

SEQ ID NO: 78723 - DNA, 19 bp, Homo sapiens
gggcagtggggtggggagg

SEQ ID NO: 78724 - DNA, 16 bp, Homo sapiens
ggatggggtgggaggg

SEQ ID NO: 78725 - DNA, 19 bp, Homo sapiens
aggaatgaactgggagagg

SEQ ID NO: 78726 - DNA, 18 bp, Homo sapiens
agggggcgggggtgggag

SEQ ID NO: 78727 - DNA, 20 bp, Homo sapiens
agggagtggagctggggagg

SEQ ID NO: 78728 - DNA, 19 bp, Homo sapiens
aggggtggggtagaaaaga

SEQ ID NO: 78729 - DNA, 20 bp, Homo sapiens
aggcggcgcggccagggagg

SEQ ID NO: 78730 - DNA, 24 bp, Homo sapiens
gggaggcgcgggtgagacgagagg

SEQ ID NO: 78731 - DNA, 20 bp, Homo sapiens
gggggcgggggtgggggagg

SEQ ID NO: 78732 - DNA, 19 bp, Homo sapiens
aggggcgccggctcagagg

SEQ ID NO: 78733 - DNA, 19 bp, Homo sapiens
agggacgcaggggcacggg

SEQ ID NO: 78734 - DNA, 17 bp, Homo sapiens
aggggtgcgaggaagag

SEQ ID NO: 78735 - DNA, 20 bp, Homo sapiens
agggggcgggggacccgagg

SEQ ID NO: 78736 - DNA, 24 bp, Homo sapiens
agggggcggggggccctggggagg

SEQ ID NO: 78737 - DNA, 19 bp, Homo sapiens
gggagcggggggcgccggg

SEQ ID NO: 78738 - DNA, 17 bp, Homo sapiens
gggaggtggcgggaggg

SEQ ID NO: 78739 - DNA, 23 bp, Homo sapiens
agagaggcaggggggtgggaggg

SEQ ID NO: 78740 - DNA, 18 bp, Homo sapiens
agggtgtggggtggaggg

SEQ ID NO: 78741 - DNA, 19 bp, Homo sapiens
gggtggtggctgggggagg

SEQ ID NO: 78742 - DNA, 22 bp, Homo sapiens
aggggtcggctccgaggagagg

SEQ ID NO: 78743 - DNA, 19 bp, Homo sapiens
agggcgtgggcgggagagg

SEQ ID NO: 78744 - DNA, 18 bp, Homo sapiens
agggaagcggggagggag

SEQ ID NO: 78745 - DNA, 21 bp, Homo sapiens
agggacgcggagcggccgagg

SEQ ID NO: 78746 - DNA, 21 bp, Homo sapiens
gggcacgggatgtgagggagg

SEQ ID NO: 78747 - DNA, 21 bp, Homo sapiens
aggagcatgaggtgggagagg

SEQ ID NO: 78748 - DNA, 19 bp, Homo sapiens
ggggcggcggcgagggagg

SEQ ID NO: 78749 - DNA, 16 bp, Homo sapiens
gggaggtggatgggag

SEQ ID NO: 78750 - DNA, 18 bp, Homo sapiens
ggggcgggggtggagagg

SEQ ID NO: 78751 - DNA, 18 bp, Homo sapiens
agggatagtggctgggag

SEQ ID NO: 78752 - DNA, 18 bp, Homo sapiens
aaggacggctgggggagg

SEQ ID NO: 78753 - DNA, 18 bp, Homo sapiens
agggactcggggagtgag

SEQ ID NO: 78754 - DNA, 21 bp, Homo sapiens
agggggcgggacgtggagagg

SEQ ID NO: 78755 - DNA, 21 bp, Homo sapiens
gggaggtggagtctggagagg

SEQ ID NO: 78756 - DNA, 22 bp, Homo sapiens
aggcgtgcgggggtggggtggg

SEQ ID NO: 78757 - DNA, 20 bp, Homo sapiens
ggtgatgcggctgagagagg

SEQ ID NO: 78758 - DNA, 16 bp, Homo sapiens
ggggcggggtggggag

SEQ ID NO: 78759 - DNA, 19 bp, Homo sapiens
gggagtgggggaagggagg

SEQ ID NO: 78760 - DNA, 20 bp, Homo sapiens
agggaggtgtacaggagagg

SEQ ID NO: 78761 - DNA, 18 bp, Homo sapiens
aggacgcgggtccagagg

SEQ ID NO: 78762 - DNA, 17 bp, Homo sapiens
gggacatggcatgggag

SEQ ID NO: 78763 - DNA, 21 bp, Homo sapiens
agggagcgcagcggggagagg

SEQ ID NO: 78764 - DNA, 19 bp, Homo sapiens
aggggcgcgagggcccagg

SEQ ID NO: 78765 - DNA, 24 bp, Homo sapiens
agggacctggttgcatgggggagg

SEQ ID NO: 78766 - DNA, 19 bp, Homo sapiens
aggggcggggagagagagg

SEQ ID NO: 78767 - DNA, 20 bp, Homo sapiens
aggggttgggagagtgggag

SEQ ID NO: 78768 - DNA, 22 bp, Homo sapiens
agggatgacccacagggagggg

SEQ ID NO: 78769 - DNA, 23 bp, Homo sapiens
agggacagtgggggtgggggaag

SEQ ID NO: 78770 - DNA, 18 bp, Homo sapiens
gggatgggctgagagagg

SEQ ID NO: 78771 - DNA, 19 bp, Homo sapiens
ggggcggatgggggagagg

SEQ ID NO: 78772 - DNA, 18 bp, Homo sapiens
aggaggtggctgggaggg

SEQ ID NO: 78773 - DNA, 20 bp, Homo sapiens
gggctcgactggtgggaggg

SEQ ID NO: 78774 - DNA, 20 bp, Homo sapiens
gggtgtggaagaagggaggg

SEQ ID NO: 78775 - DNA, 19 bp, Homo sapiens
aggaagaaggtgggggagg

SEQ ID NO: 78776 - DNA, 17 bp, Homo sapiens
aggtgcacgtgggagag

SEQ ID NO: 78777 - DNA, 23 bp, Homo sapiens
gggaggtgggggagtgggggagg

SEQ ID NO: 78778 - DNA, 20 bp, Homo sapiens
aggatgcgggggtggggcgg

SEQ ID NO: 78779 - DNA, 15 bp, Homo sapiens
gggagcggggaggag

SEQ ID NO: 78780 - DNA, 17 bp, Homo sapiens
gggcgctgagtggaggg

SEQ ID NO: 78781 - DNA, 18 bp, Homo sapiens
agggacgtggtgggcggg

SEQ ID NO: 78782 - DNA, 19 bp, Homo sapiens
gggagcggaccccgagagg

SEQ ID NO: 78783 - DNA, 22 bp, Homo sapiens
ggggcagtgggccatggggagg

SEQ ID NO: 78784 - DNA, 24 bp, Homo sapiens
aggggtgcgggggctgccgtcagg

SEQ ID NO: 78785 - DNA, 18 bp, Homo sapiens
aggggcaggctgggaggg

SEQ ID NO: 78786 - DNA, 18 bp, Homo sapiens
gggtggcgtgggtgagag

SEQ ID NO: 78787 - DNA, 20 bp, Homo sapiens
gggacgtggaggcgatgagg

SEQ ID NO: 78788 - DNA, 20 bp, Homo sapiens
agggatggggctgttggagg

SEQ ID NO: 78789 - DNA, 17 bp, Homo sapiens
aggggtgggatggggag

SEQ ID NO: 78790 - DNA, 21 bp, Homo sapiens
gggccgtgggggtggtggggg

SEQ ID NO: 78791 - DNA, 19 bp, Homo sapiens
aggagatgcggggcagagg

SEQ ID NO: 78792 - DNA, 20 bp, Homo sapiens
aggggcgcggctgggagagg

SEQ ID NO: 78793 - DNA, 23 bp, Homo sapiens
agggaggtggggcgcagtggagg

SEQ ID NO: 78794 - DNA, 18 bp, Homo sapiens
agggacgctggttgtgga

SEQ ID NO: 78795 - DNA, 17 bp, Homo sapiens
gagaagggtgggggagg

SEQ ID NO: 78796 - DNA, 16 bp, Homo sapiens
aggggccgggagggag

SEQ ID NO: 78797 - DNA, 23 bp, Homo sapiens
agggaagtgagctgtgggagagg

SEQ ID NO: 78798 - DNA, 22 bp, Homo sapiens
gggcggcggggggacgggaggg

SEQ ID NO: 78799 - DNA, 19 bp, Homo sapiens
ggggcggtggggggaaagg

SEQ ID NO: 78800 - DNA, 19 bp, Homo sapiens
aggggcgcaggggcagagg

SEQ ID NO: 78801 - DNA, 18 bp, Homo sapiens
aggggcggggggctggag

SEQ ID NO: 78802 - DNA, 21 bp, Homo sapiens
aggagcgtggggaaggggagg

SEQ ID NO: 78803 - DNA, 23 bp, Homo sapiens
gggatggtggcaagtgggggagg

SEQ ID NO: 78804 - DNA, 18 bp, Homo sapiens
aggggctggggggctggg

SEQ ID NO: 78805 - DNA, 20 bp, Homo sapiens
agggggcggaggagggaggg

SEQ ID NO: 78806 - DNA, 17 bp, Homo sapiens
ggggcgggggctaaggg

SEQ ID NO: 78807 - DNA, 23 bp, Homo sapiens
agggactggggtttattggaggg

SEQ ID NO: 78808 - DNA, 22 bp, Homo sapiens
aggggcgtgggggctgaaccag

SEQ ID NO: 78809 - DNA, 24 bp, Homo sapiens
gggaggcgggggtacctggggagg

SEQ ID NO: 78810 - DNA, 24 bp, Homo sapiens
gggaggtgggggtacccggggagg

SEQ ID NO: 78811 - DNA, 21 bp, Homo sapiens
aggagcgtggggggaaccagg

SEQ ID NO: 78812 - DNA, 21 bp, Homo sapiens
agggctgcgggggctcccagg

SEQ ID NO: 78813 - DNA, 20 bp, Homo sapiens
ggggtgaaaggtgggggagg

SEQ ID NO: 78814 - DNA, 22 bp, Homo sapiens
gggctgggcaagggtgggaggg

SEQ ID NO: 78815 - DNA, 18 bp, Homo sapiens
ggggcaagggtgggaggg

SEQ ID NO: 78816 - DNA, 15 bp, Homo sapiens
gggacgagtgggagg

SEQ ID NO: 78817 - DNA, 21 bp, Homo sapiens
gggcgcgggaaatcggagagg

SEQ ID NO: 78818 - DNA, 23 bp, Homo sapiens
gggatgggggggcttgccagagg

SEQ ID NO: 78819 - DNA, 17 bp, Homo sapiens
agggctgagtgggagag

SEQ ID NO: 78820 - DNA, 21 bp, Homo sapiens
gggatggggggtggatggagg

SEQ ID NO: 78821 - DNA, 15 bp, Homo sapiens
ggggaagatgggagg

SEQ ID NO: 78822 - DNA, 19 bp, Homo sapiens
ggggggcgggaactgggag

SEQ ID NO: 78823 - DNA, 20 bp, Homo sapiens
ggtgatggacgtgggagagg

SEQ ID NO: 78824 - DNA, 19 bp, Homo sapiens
gggatgcgcgggcgtcggg

SEQ ID NO: 78825 - DNA, 19 bp, Homo sapiens
ggggctggaggaggagagg

SEQ ID NO: 78826 - DNA, 21 bp, Homo sapiens
ggggtgggggggcacaagagg

SEQ ID NO: 78827 - DNA, 19 bp, Homo sapiens
aggggcgaggccggagagg

SEQ ID NO: 78828 - DNA, 17 bp, Homo sapiens
gggaggcggcgggggag

SEQ ID NO: 78829 - DNA, 20 bp, Homo sapiens
gggatcgaaaagagggaggg

SEQ ID NO: 78830 - DNA, 20 bp, Homo sapiens
agggatctggggtgtagagg

SEQ ID NO: 78831 - DNA, 19 bp, Homo sapiens
gggacgagggtgtggaggg

SEQ ID NO: 78832 - DNA, 20 bp, Homo sapiens
gggtcgcgggggaccgcggg

SEQ ID NO: 78833 - DNA, 20 bp, Homo sapiens
gggaggcccgctgggagagg

SEQ ID NO: 78834 - DNA, 17 bp, Homo sapiens
aggggcggggggaagag

SEQ ID NO: 78835 - DNA, 21 bp, Homo sapiens
gggggcgggcggtgggggagg

SEQ ID NO: 78836 - DNA, 19 bp, Homo sapiens
aggagcgcggagccgagag

SEQ ID NO: 78837 - DNA, 20 bp, Homo sapiens
gggacgcggggcggcgggag

SEQ ID NO: 78838 - DNA, 20 bp, Homo sapiens
agggggcggtcccggggagg

SEQ ID NO: 78839 - DNA, 20 bp, Homo sapiens
agggacagtgggtgaagagg

SEQ ID NO: 78840 - DNA, 19 bp, Homo sapiens
aggggcgggggaggggagg

SEQ ID NO: 78841 - DNA, 16 bp, Homo sapiens
agggatcggggaagag

SEQ ID NO: 78842 - DNA, 20 bp, Homo sapiens
aggcgcagctgtgggggagg

SEQ ID NO: 78843 - DNA, 22 bp, Homo sapiens
gggacgcggtgtctttcagagg

SEQ ID NO: 78844 - DNA, 18 bp, Homo sapiens
aggggccgggagggaggg

SEQ ID NO: 78845 - DNA, 23 bp, Homo sapiens
gggcggggcgggggtgggagagg

SEQ ID NO: 78846 - DNA, 23 bp, Homo sapiens
ggggtgtggaggtgggagtcagg

SEQ ID NO: 78847 - DNA, 18 bp, Homo sapiens
gggacgcgggggcgctgg

SEQ ID NO: 78848 - DNA, 20 bp, Homo sapiens
gggatgcggggggcagcggg

SEQ ID NO: 78849 - DNA, 22 bp, Homo sapiens
agggatgtcgggggtactcagg

SEQ ID NO: 78850 - DNA, 19 bp, Homo sapiens
ggggtgcggagcctgggag

SEQ ID NO: 78851 - DNA, 21 bp, Homo sapiens
ggggcgcggggaccgaggagg

SEQ ID NO: 78852 - DNA, 26 bp, Homo sapiens
agggctgcgggagttactgggggagg

SEQ ID NO: 78853 - DNA, 22 bp, Homo sapiens
ggggcgtgggggaaaggggagg

SEQ ID NO: 78854 - DNA, 16 bp, Homo sapiens
ggggcgggagcgagag

SEQ ID NO: 78855 - DNA, 18 bp, Homo sapiens
aggggtggggggtgggag

SEQ ID NO: 78856 - DNA, 20 bp, Homo sapiens
gggggcgtgggcggaagggg

SEQ ID NO: 78857 - DNA, 20 bp, Homo sapiens
aaggatgtgggggctgggag

SEQ ID NO: 78858 - DNA, 20 bp, Homo sapiens
gggacgcggcggccagcagg

SEQ ID NO: 78859 - DNA, 23 bp, Homo sapiens
gggagcgcggggggagggggagg

SEQ ID NO: 78860 - DNA, 20 bp, Homo sapiens
aggggcgcagggcggagagg

SEQ ID NO: 78861 - DNA, 21 bp, Homo sapiens
agggagcaggagtgggggagg

SEQ ID NO: 78862 - DNA, 16 bp, Homo sapiens
agggatggggagggag

SEQ ID NO: 78863 - DNA, 22 bp, Homo sapiens
agggggtggcatgtgggagagg

SEQ ID NO: 78864 - DNA, 16 bp, Homo sapiens
agggacgggaggagag

SEQ ID NO: 78865 - DNA, 20 bp, Homo sapiens
aggggggtgggatggggagg

SEQ ID NO: 78866 - DNA, 20 bp, Homo sapiens
gggactgggggtggataggg

SEQ ID NO: 78867 - DNA, 18 bp, Homo sapiens
aggtgatgcggggcggag

SEQ ID NO: 78868 - DNA, 20 bp, Homo sapiens
agaggcgcgggcgagggagg

SEQ ID NO: 78869 - DNA, 21 bp, Homo sapiens
ggggtgggcctggtggggagg

SEQ ID NO: 78870 - DNA, 20 bp, Homo sapiens
gggactgtgaagaggggagg

SEQ ID NO: 78871 - DNA, 19 bp, Homo sapiens
agggggcggggaggagagg

SEQ ID NO: 78872 - DNA, 19 bp, Homo sapiens
ggggcggtggggggctggg

SEQ ID NO: 78873 - DNA, 17 bp, Homo sapiens
aggggtgagggagagag

SEQ ID NO: 78874 - DNA, 18 bp, Homo sapiens
gggaagcgggggtctgag

SEQ ID NO: 78875 - DNA, 129 bp, Gallid herpesvirus 2
tgatcgttgtttcgaaccgcgaataaaactttcatacatactaaacgatggagttgtgttttatgagcgttgaaaacaaaggtaccatcggtttaaaactaagttgcatatcgtaatccacaaaaatca

SEQ ID NO: 78876 - DNA, 24 bp, Gallid herpesvirus 2
aggtaccatcggtttaaaactaag

SEQ ID NO: 78877 - DNA, 18 bp, Homo sapiens
aggtgccatcgctttaaa

SEQ ID NO: 78878 - DNA, 20 bp, Homo sapiens
aggtaccaataacaaaagct

SEQ ID NO: 78879 - DNA, 21 bp, Homo sapiens
agataccatgttcaagaaact

SEQ ID NO: 78880 - DNA, 22 bp, Homo sapiens
aggtcctgtctctttaaaacta

SEQ ID NO: 78881 - DNA, 18 bp, Homo sapiens
gtagcaggtttaaaacta

SEQ ID NO: 78882 - DNA, 18 bp, Homo sapiens
aggattgttcaaaactaa

SEQ ID NO: 78883 - DNA, 81 bp, Human herpesvirus 3
tttgctacagcttatataaatttatgtgcgatacatcttaagtgcatccgtacgttatttatacattgcctgtcacgtgaa

SEQ ID NO: 78884 - DNA, 20 bp, Human herpesvirus 3
tacattgcctgtcacgtgaa

SEQ ID NO: 78885 - DNA, 17 bp, Homo sapiens
caccactgtcacgtgaa

SEQ ID NO: 78886 - DNA, 17 bp, Homo sapiens
tacactgcaccatcgtg

SEQ ID NO: 78887 - DNA, 18 bp, Homo sapiens
tacactgctttcactgaa

SEQ ID NO: 78888 - DNA, 17 bp, Homo sapiens
cacattgccttccctga

SEQ ID NO: 78889 - DNA, 20 bp, Homo sapiens
tacattacctgtacacataa

SEQ ID NO: 78890 - DNA, 17 bp, Homo sapiens
caccggcgtcacgtgaa

SEQ ID NO: 78891 - DNA, 18 bp, Homo sapiens
tacttgtctgtcacaatg

SEQ ID NO: 78892 - DNA, 17 bp, Homo sapiens
tacactgctggtgtgaa

SEQ ID NO: 78893 - DNA, 19 bp, Homo sapiens
tacagtgcctggcacagaa

SEQ ID NO: 78894 - DNA, 18 bp, Homo sapiens
tacgttgcctggacttga

SEQ ID NO: 78895 - DNA, 16 bp, Homo sapiens
tacatcgcttgtgtga

SEQ ID NO: 78896 - DNA, 19 bp, Homo sapiens
tacattacctgtcaatgaa

SEQ ID NO: 78897 - DNA, 16 bp, Homo sapiens
tacattgccttcactg

SEQ ID NO: 78898 - DNA, 17 bp, Homo sapiens
cacgttgacctgtgtga

SEQ ID NO: 78899 - DNA, 18 bp, Homo sapiens
tgcactttatcacgtgaa

SEQ ID NO: 78900 - DNA, 20 bp, Homo sapiens
tacattgccctgcctaatga

SEQ ID NO: 78901 - DNA, 18 bp, Homo sapiens
tacattgcatcgtttgaa

SEQ ID NO: 78902 - DNA, 20 bp, Homo sapiens
tacatgcactgtcacgtgaa

SEQ ID NO: 78903 - DNA, 19 bp, Homo sapiens
cacattgctgggcagtgaa

SEQ ID NO: 78904 - DNA, 18 bp, Homo sapiens
tacactgctcttggtgaa

SEQ ID NO: 78905 - DNA, 20 bp, Homo sapiens
tacattgcttttcatcagaa

SEQ ID NO: 78906 - DNA, 19 bp, Homo sapiens
tacatttctgtccacatga

SEQ ID NO: 78907 - DNA, 19 bp, Homo sapiens
acattgacttccacgtgaa

SEQ ID NO: 78908 - DNA, 18 bp, Homo sapiens
tacattgcctgatacata

SEQ ID NO: 78909 - DNA, 18 bp, Homo sapiens
cacattgcctctggtgaa

SEQ ID NO: 78910 - DNA, 15 bp, Homo sapiens
tacattgcctgttga

SEQ ID NO: 78911 - DNA, 16 bp, Homo sapiens
tacactgccacagtga

SEQ ID NO: 78912 - DNA, 18 bp, Homo sapiens
cattgcctttagtccatg

SEQ ID NO: 78913 - DNA, 16 bp, Homo sapiens
acattgcctgccatga

SEQ ID NO: 78914 - DNA, 18 bp, Homo sapiens
cacattgcttacatttga

SEQ ID NO: 78915 - DNA, 63 bp, Melanoplus sanguinipes entomopoxvirus
aataaaaatttcataaattcatataaagattttgtttttttttctttttattaattttttatt

SEQ ID NO: 78916 - DNA, 24 bp, Melanoplus sanguinipes entomopoxvirus
taaaaatttcataaattcatataa

SEQ ID NO: 78917 - DNA, 18 bp, Homo sapiens
taaaaatttcataattcc

SEQ ID NO: 78918 - DNA, 23 bp, Homo sapiens
taaaattctcaaaattcatataa

SEQ ID NO: 78919 - DNA, 24 bp, Homo sapiens
taaaagcttcatatagctcatata

SEQ ID NO: 78920 - DNA, 73 bp, Melanoplus sanguinipes entomopoxvirus
tatttttgtttgaagaaagaatgccataatgacgtaatcaataaaatgtcattattttttcaaaaataaaata

SEQ ID NO: 78921 - DNA, 24 bp, Melanoplus sanguinipes entomopoxvirus
tgtttgaagaaagaatgccataat

SEQ ID NO: 78922 - DNA, 21 bp, Homo sapiens
tgtttgaagaaagagttccat

SEQ ID NO: 78923 - DNA, 18 bp, Homo sapiens
tgtttgaaaagttaccac

SEQ ID NO: 78924 - DNA, 18 bp, Homo sapiens
tgtttgaagaaatatcca

SEQ ID NO: 78925 - DNA, 20 bp, Homo sapiens
tgttagaagaaaggaagcca

SEQ ID NO: 78926 - DNA, 19 bp, Homo sapiens
tgtttgaaggcagagtcca

SEQ ID NO: 78927 - DNA, 18 bp, Homo sapiens
tgtttgaagaaggaggcc

SEQ ID NO: 78928 - DNA, 20 bp, Homo sapiens
tgtttgaagcaaagggttcc

SEQ ID NO: 78929 - DNA, 17 bp, Homo sapiens
tgtttgaaaaagagtgc

SEQ ID NO: 78930 - DNA, 20 bp, Homo sapiens
tgcttgaagaagcagccata

SEQ ID NO: 78931 - DNA, 23 bp, Homo sapiens
tatttgaaggaagggtagcacat

SEQ ID NO: 78932 - DNA, 22 bp, Homo sapiens
tgtttgaaaatcacactgccat

SEQ ID NO: 78933 - DNA, 19 bp, Homo sapiens
tttgaagaatctccataat

SEQ ID NO: 78934 - DNA, 84 bp, Porcine epidemic diarrhea virus
taccttcgtccaattggttaatctgtgcttcacttgtcaccggttgtgtaatagcgcagtttatacacctatagggcgcctgta

SEQ ID NO: 78935 - DNA, 24 bp, Porcine epidemic diarrhea virus
tagcgcagtttatacacctatagg

SEQ ID NO: 78936 - DNA, 30 bp, Homo sapiens
tagtgctgtttatacattcaagcctatagg

SEQ ID NO: 78937 - DNA, 23 bp, Homo sapiens
taggcagtttatggccatatagg

SEQ ID NO: 78938 - DNA, 21 bp, Homo sapiens
agcgcagcggccatttatagg

SEQ ID NO: 78939 - DNA, 24 bp, Homo sapiens
agcgcagtggctcacgtctgtagg

SEQ ID NO: 78940 - DNA, 65 bp, Plum pox virus
tccgctttaatagcagtacattcagtgaggttttacctccatatgtgctagtctgttattgtcga

SEQ ID NO: 78941 - DNA, 24 bp, Plum pox virus
agcagtacattcagtgaggtttta

SEQ ID NO: 78942 - DNA, 21 bp, Homo sapiens
agtagtataattagtaaggtt

SEQ ID NO: 78943 - DNA, 17 bp, Homo sapiens
agtagtacattagtgag

SEQ ID NO: 78944 - DNA, 21 bp, Homo sapiens
gcagagctagctgaggtttta

SEQ ID NO: 78945 - DNA, 19 bp, Homo sapiens
agcagtacggtcctgtttt

SEQ ID NO: 78946 - DNA, 21 bp, Homo sapiens
agcagcacgttactggtttta

SEQ ID NO: 78947 - DNA, 23 bp, Homo sapiens
agtagttattcagtataaggttt

SEQ ID NO: 78948 - DNA, 22 bp, Homo sapiens
agaagtacatttggtggagttt

SEQ ID NO: 78949 - DNA, 22 bp, Homo sapiens
gcgtctgttcagtgaggtttta

SEQ ID NO: 78950 - DNA, 21 bp, Homo sapiens
aacagtatatcctaaggtttt

SEQ ID NO: 78951 - DNA, 22 bp, Homo sapiens
agtagtacacttagtgtaattt

SEQ ID NO: 78952 - DNA, 24 bp, Homo sapiens
agcagtactgtttggtgtgtgttt

SEQ ID NO: 78953 - DNA, 22 bp, Homo sapiens
agcagtcatgtcataggtttta

SEQ ID NO: 78954 - DNA, 16 bp, Homo sapiens
gtacattcaaaatttt

SEQ ID NO: 78955 - DNA, 16 bp, Homo sapiens
agtacattcaggcttt

SEQ ID NO: 78956 - DNA, 24 bp, Homo sapiens
gcatccatcttcggtgaggtttta

SEQ ID NO: 78957 - DNA, 18 bp, Homo sapiens
agaagtgcattcagtggg

SEQ ID NO: 78958 - DNA, 60 bp, Plum pox virus
cacaggcccttgtatctgatgtagcgagtgtttcactccattcgggttatagttcttgtg

SEQ ID NO: 78959 - DNA, 24 bp, Plum pox virus
tccattcgggttatagttcttgtg

SEQ ID NO: 78960 - DNA, 20 bp, Homo sapiens
ccatgtgtatagttcttgtg

SEQ ID NO: 78961 - DNA, 21 bp, Homo sapiens
tccctgtctgtggttcttgtg

SEQ ID NO: 78962 - DNA, 21 bp, Homo sapiens
cattctggttatacccttgtg

SEQ ID NO: 78963 - DNA, 62 bp, Rabbit fibroma virus
cttaatggttcattcgttcgtatattctttttcgattttttattcaacgctaataccttaag

SEQ ID NO: 78964 - DNA, 24 bp, Rabbit fibroma virus
taatggttcattcgttcgtatatt

SEQ ID NO: 78965 - DNA, 17 bp, Homo sapiens
tggttcattctatctat

SEQ ID NO: 78966 - DNA, 18 bp, Homo sapiens
taatggtttattcagttc

SEQ ID NO: 78967 - DNA, 25 bp, Homo sapiens
caatggtttaaatcttttgtatatt

SEQ ID NO: 78968 - DNA, 124 bp, Rabbit fibroma virus
ttcttttatgacggataatgtagcggccgattcagcgtccaggtcgatgtccttgttggtcaacaaagtcgacaacaagtgcatgaaattagactcgttgatatcctcgtcgctcatttaagaa

SEQ ID NO: 78969 - DNA, 24 bp, Rabbit fibroma virus
cgacaacaagtgcatgaaattaga

SEQ ID NO: 78970 - DNA, 21 bp, Homo sapiens
catcaagtgcagtacattaga

SEQ ID NO: 78971 - DNA, 21 bp, Homo sapiens
gacactataattgaaattaga

SEQ ID NO: 78972 - DNA, 21 bp, Homo sapiens
gacaacaagtgcatttattag

SEQ ID NO: 78973 - DNA, 23 bp, Homo sapiens
acaactcttgatatgaaattaga

SEQ ID NO: 78974 - DNA, 19 bp, Homo sapiens
cacagcagcctgaaattag

SEQ ID NO: 78975 - DNA, 17 bp, Homo sapiens
acaacaagataaattag

SEQ ID NO: 78976 - DNA, 23 bp, Homo sapiens
cgagggcaagtgcatcaaagcag

SEQ ID NO: 78977 - DNA, 17 bp, Homo sapiens
acaaaacgtgaaattag

SEQ ID NO: 78978 - DNA, 24 bp, Homo sapiens
gacaaaatttaccatggaattaga

SEQ ID NO: 78979 - DNA, 22 bp, Homo sapiens
gacaggaatactgtgaaattag

SEQ ID NO: 78980 - DNA, 22 bp, Homo sapiens
gacaataggtgcatgacaccag

SEQ ID NO: 78981 - DNA, 19 bp, Homo sapiens
acagcaagggagaaattag

SEQ ID NO: 78982 - DNA, 18 bp, Homo sapiens
tgaagtggctgaaattag

SEQ ID NO: 78983 - DNA, 17 bp, Homo sapiens
aacagcatgaaattgga

SEQ ID NO: 78984 - DNA, 17 bp, Homo sapiens
acaatgcttgaaattag

SEQ ID NO: 78985 - DNA, 21 bp, Homo sapiens
gacacgaaagtggaagttaga

SEQ ID NO: 78986 - DNA, 84 bp, Rat cytomegalovirus
gtgagcccggccggcggagcctccgaccctttatagcgtttgtgacgcacccggaaaggagaaccgcggccgctgggtcctcac

SEQ ID NO: 78987 - DNA, 24 bp, Rat cytomegalovirus
cacccggaaaggagaaccgcggcc

SEQ ID NO: 78988 - DNA, 21 bp, Homo sapiens
cacccagaagggagatgtgcc

SEQ ID NO: 78989 - DNA, 18 bp, Homo sapiens
ccggaaaggagggcaggc

SEQ ID NO: 78990 - DNA, 21 bp, Homo sapiens
ccggaataccaggccgcggcc

SEQ ID NO: 78991 - DNA, 21 bp, Homo sapiens
cacccggaggggagggaaggc

SEQ ID NO: 78992 - DNA, 27 bp, Homo sapiens
cacccagagaggagactgcaggcggcc

SEQ ID NO: 78993 - DNA, 20 bp, Homo sapiens
cgcctggggatcccgcggcc

SEQ ID NO: 78994 - DNA, 21 bp, Homo sapiens
cccgctccgggaaccgcggcc

SEQ ID NO: 78995 - DNA, 21 bp, Homo sapiens
caccatgtgagagccgcggcc

SEQ ID NO: 78996 - DNA, 23 bp, Homo sapiens
cccgggggggagtggccgcggcc

SEQ ID NO: 78997 - DNA, 21 bp, Homo sapiens
cccggggctgcggccgcggcc

SEQ ID NO: 78998 - DNA, 22 bp, Homo sapiens
cccggaaaaagctcagccgcgg

SEQ ID NO: 78999 - DNA, 18 bp, Homo sapiens
cctcggggaggccgcggc

SEQ ID NO: 79000 - DNA, 20 bp, Homo sapiens
cacccggaaggcgagggcag

SEQ ID NO: 79001 - DNA, 19 bp, Homo sapiens
cctggaaaagagatgcgcc

SEQ ID NO: 79002 - DNA, 23 bp, Homo sapiens
actccgctgctgggaccgcggcc

SEQ ID NO: 79003 - DNA, 23 bp, Homo sapiens
cctggaaaggagaagacagtggc

SEQ ID NO: 79004 - DNA, 19 bp, Homo sapiens
cccggaaagcagaggacgg

SEQ ID NO: 79005 - DNA, 21 bp, Homo sapiens
cacttggaaaggaggtggagc

SEQ ID NO: 79006 - DNA, 16 bp, Homo sapiens
ggaggaggccgcggcc

SEQ ID NO: 79007 - DNA, 17 bp, Homo sapiens
cacccgggagccgcggc

SEQ ID NO: 79008 - DNA, 17 bp, Homo sapiens
cacccagagaggggcag

SEQ ID NO: 79009 - DNA, 16 bp, Homo sapiens
cggaaaggagaagcgg

SEQ ID NO: 79010 - DNA, 23 bp, Homo sapiens
cccgtccagggggagccgcggcc

SEQ ID NO: 79011 - DNA, 19 bp, Homo sapiens
cacctggaaggagaaaacc

SEQ ID NO: 79012 - DNA, 21 bp, Homo sapiens
cacccggacgggcccgcggcc

SEQ ID NO: 79013 - DNA, 18 bp, Homo sapiens
cacacgcagggccgcggc

SEQ ID NO: 79014 - DNA, 19 bp, Homo sapiens
ccctggggcccccgcggcc

SEQ ID NO: 79015 - DNA, 20 bp, Homo sapiens
actcgcagggctccgcggcc

SEQ ID NO: 79016 - DNA, 23 bp, Homo sapiens
ccctggggtagtaagccgcggcc

SEQ ID NO: 79017 - DNA, 23 bp, Homo sapiens
cactggaggaggtggccgcggcc

SEQ ID NO: 79018 - DNA, 21 bp, Homo sapiens
cccggaaagggaaacggagcc

SEQ ID NO: 79019 - DNA, 20 bp, Homo sapiens
cctggatggtctccgcggcc

SEQ ID NO: 79020 - DNA, 18 bp, Homo sapiens
cgggaaggggccgcggcc

SEQ ID NO: 79021 - DNA, 16 bp, Homo sapiens
ggaaagagaacaaacc

SEQ ID NO: 79022 - DNA, 22 bp, Homo sapiens
ccctcacctgagagccgcggcc

SEQ ID NO: 79023 - DNA, 20 bp, Homo sapiens
ccctccagagagccgcggcc

SEQ ID NO: 79024 - DNA, 21 bp, Homo sapiens
cccgagtggggaaccgcggcc

SEQ ID NO: 79025 - DNA, 15 bp, Homo sapiens
ggaaaggaaaacggc

SEQ ID NO: 79026 - DNA, 18 bp, Homo sapiens
cactcggggacccgcggc

SEQ ID NO: 79027 - DNA, 21 bp, Homo sapiens
caccctggaaggggcctgggc

SEQ ID NO: 79028 - DNA, 18 bp, Homo sapiens
cacctggaaaggagtcgg

SEQ ID NO: 79029 - DNA, 18 bp, Homo sapiens
cctggggaaaccgcggcc

SEQ ID NO: 79030 - DNA, 21 bp, Homo sapiens
actcggaaaggagagacaaag

SEQ ID NO: 79031 - DNA, 20 bp, Homo sapiens
cacccggacaaggaggtcgc

SEQ ID NO: 79032 - DNA, 16 bp, Homo sapiens
cacctggaaagggcag

SEQ ID NO: 79033 - DNA, 18 bp, Homo sapiens
acccggaagcaccgtggc

SEQ ID NO: 79034 - DNA, 17 bp, Homo sapiens
ggacaggagccgcggcc

SEQ ID NO: 79035 - DNA, 19 bp, Homo sapiens
cacgcgcagggaccgcggc

SEQ ID NO: 79036 - DNA, 20 bp, Homo sapiens
cggttggtaggaaccgcggc

SEQ ID NO: 79037 - DNA, 22 bp, Homo sapiens
cctgggaaggtaccccgcggcc

SEQ ID NO: 79038 - DNA, 21 bp, Homo sapiens
cacctggcagggaaaatggcc

SEQ ID NO: 79039 - DNA, 24 bp, Homo sapiens
cactaggggaggagaactgttgcc

SEQ ID NO: 79040 - DNA, 21 bp, Homo sapiens
cacccagaggggagggggacc

SEQ ID NO: 79041 - DNA, 21 bp, Homo sapiens
cacccggaacagggggacagc

SEQ ID NO: 79042 - DNA, 20 bp, Homo sapiens
cacccggaacaggagggcag

SEQ ID NO: 79043 - DNA, 15 bp, Homo sapiens
ccggaaaggaggcgg

SEQ ID NO: 79044 - DNA, 21 bp, Homo sapiens
cctggagaagcggccgcggcc

SEQ ID NO: 79045 - DNA, 17 bp, Homo sapiens
ccgccaagagccgcggc

SEQ ID NO: 79046 - DNA, 23 bp, Homo sapiens
cacccggaagggtgacggcagcc

SEQ ID NO: 79047 - DNA, 19 bp, Homo sapiens
ccctggggaaaaccgtggc

SEQ ID NO: 79048 - DNA, 21 bp, Homo sapiens
cccggaggagacgccgcggcc

SEQ ID NO: 79049 - DNA, 18 bp, Homo sapiens
ggaggagctgccgcggcc

SEQ ID NO: 79050 - DNA, 98 bp, Human herpesvirus 2
ggcggtagcggacgcacggcggacacaataacaaacagaccgcggacacggagggagtcggttgggttgggcgtggacgccgctgcgtccacacaccc

SEQ ID NO: 79051 - DNA, 24 bp, Human herpesvirus 2
acacaataacaaacagaccgcgga

SEQ ID NO: 79052 - DNA, 21 bp, Homo sapiens
acacggtgaccaaaccacgga

SEQ ID NO: 79053 - DNA, 20 bp, Homo sapiens
cacaaaacagacagaaacag

SEQ ID NO: 79054 - DNA, 19 bp, Homo sapiens
acacaacagcaaatagcag

SEQ ID NO: 79055 - DNA, 21 bp, Homo sapiens
acacaataataaataagacca

SEQ ID NO: 79056 - DNA, 19 bp, Homo sapiens
acacaatacaaacgtgcgg

SEQ ID NO: 79057 - DNA, 19 bp, Homo sapiens
acgcaatacaaacaaatgg

SEQ ID NO: 79058 - DNA, 22 bp, Homo sapiens
acaaggtaacaaatagagcaga

SEQ ID NO: 79059 - DNA, 19 bp, Homo sapiens
acacaacagcagacacaaa

SEQ ID NO: 79060 - DNA, 19 bp, Homo sapiens
cacaggaacagacagacca

SEQ ID NO: 79061 - DNA, 20 bp, Homo sapiens
acacaataaataggtggcgg

SEQ ID NO: 79062 - DNA, 20 bp, Homo sapiens
cacagggacaaaccactgga

SEQ ID NO: 79063 - DNA, 21 bp, Homo sapiens
cacaataatacatcaatcgga

SEQ ID NO: 79064 - DNA, 18 bp, Homo sapiens
acacaataacaaatggac

SEQ ID NO: 79065 - DNA, 97 bp, Human herpesvirus 2
tcccaataaagtgcagtcgttttctaacccacggatgccgttgtatgcctatacgggggactatggggggggaaaggaaaggaaacaggaatggaga

SEQ ID NO: 79066 - DNA, 24 bp, Human herpesvirus 2
agtcgttttctaacccacggatgc

SEQ ID NO: 79067 - DNA, 20 bp, Homo sapiens
agtccttttctaacccatgg

SEQ ID NO: 79068 - DNA, 18 bp, Homo sapiens
agtcattttctatggatg

SEQ ID NO: 79069 - DNA, 15 bp, Homo sapiens
gttttctccacggat

SEQ ID NO: 79070 - DNA, 21 bp, Homo sapiens
agtcgtttttcaatttctcgg

SEQ ID NO: 79071 - DNA, 15 bp, Homo sapiens
agtcgttttctggtg

SEQ ID NO: 79072 - DNA, 22 bp, Homo sapiens
agttgtcttgacaccacggatg

SEQ ID NO: 79073 - DNA, 64 bp, Paramecium bursaria Chlorella virus 1
tcgaaataaactttctcattggttagcataggctgcagtggagttccaatcaatagaatttcgg

SEQ ID NO: 79074 - DNA, 24 bp, Paramecium bursaria Chlorella virus 1
tgcagtggagttccaatcaataga

SEQ ID NO: 79075 - DNA, 18 bp, Homo sapiens
tgcagtgagtttcaatca

SEQ ID NO: 79076 - DNA, 23 bp, Homo sapiens
tgcatggagtttcaaagctaaga

SEQ ID NO: 79077 - DNA, 19 bp, Homo sapiens
tgcagtggaggtttcagtc

SEQ ID NO: 79078 - DNA, 21 bp, Homo sapiens
gcagagcccgcaatcagtaga

SEQ ID NO: 79079 - DNA, 22 bp, Homo sapiens
tgcaggggcattgatcagtaga

SEQ ID NO: 79080 - DNA, 19 bp, Homo sapiens
tgcagtggatttccgatca

SEQ ID NO: 79081 - DNA, 16 bp, Homo sapiens
tgcatggagtttcaca

SEQ ID NO: 79082 - DNA, 22 bp, Homo sapiens
tggtcactcaccaatcaataga

SEQ ID NO: 79083 - DNA, 20 bp, Homo sapiens
cagtggagattatcagtaga

SEQ ID NO: 79084 - DNA, 21 bp, Homo sapiens
tgcatggagttccaaggtaga

SEQ ID NO: 79085 - DNA, 18 bp, Homo sapiens
tgcagtgagtttctctag

SEQ ID NO: 79086 - DNA, 18 bp, Homo sapiens
tgagtggagttttgatca

SEQ ID NO: 79087 - DNA, 75 bp, Sulfolobus virus SIRV-2
gcttaatttttagatatagttgaataattgcaaataatgtagttgcagttgtagaaactacagttaaaattaagc

SEQ ID NO: 79088 - DNA, 24 bp, Sulfolobus virus SIRV-2
agttgtagaaactacagttaaaat

SEQ ID NO: 79089 - DNA, 17 bp, Homo sapiens
agtttagaaactaaagt

SEQ ID NO: 79090 - DNA, 21 bp, Homo sapiens
agttgtagagacacttaaaat

SEQ ID NO: 79091 - DNA, 23 bp, Homo sapiens
agttgttagaaaaacattaaaat

SEQ ID NO: 79092 - DNA, 20 bp, Homo sapiens
attacacaagctacagttaa

SEQ ID NO: 79093 - DNA, 19 bp, Homo sapiens
agttgtaaggctacaacta

SEQ ID NO: 79094 - DNA, 17 bp, Homo sapiens
gttgtagatactatgtt

SEQ ID NO: 79095 - DNA, 19 bp, Homo sapiens
agttgtagaaataatacag

SEQ ID NO: 79096 - DNA, 19 bp, Homo sapiens
agttgtagaaatacacagt

SEQ ID NO: 79097 - DNA, 19 bp, Homo sapiens
agttgcagaaacaaattaa

SEQ ID NO: 79098 - DNA, 18 bp, Homo sapiens
agttgtagaaatagacaa

SEQ ID NO: 79099 - DNA, 18 bp, Homo sapiens
agttatagaaattagtca

SEQ ID NO: 79100 - DNA, 18 bp, Homo sapiens
agatgtatacagttaaaa

SEQ ID NO: 79101 - DNA, 18 bp, Homo sapiens
agtggtggagactacagt

SEQ ID NO: 79102 - DNA, 23 bp, Homo sapiens
agttgtaggtaacctcataaaat

SEQ ID NO: 79103 - DNA, 20 bp, Homo sapiens
agttgtaaaaattgatacag

SEQ ID NO: 79104 - DNA, 18 bp, Homo sapiens
agttgtagaagcaacaat

SEQ ID NO: 79105 - DNA, 86 bp, Porcine adenovirus A
cttcgccagggaagggattcacccggagtacttttgcatcacccgcgagcactttgaggccgagtgcatccccgactctctgcaag

SEQ ID NO: 79106 - DNA, 24 bp, Porcine adenovirus A
cacccggagtacttttgcatcacc

SEQ ID NO: 79107 - DNA, 19 bp, Homo sapiens
cccggagtcttaagacacc

SEQ ID NO: 79108 - DNA, 17 bp, Homo sapiens
cctgggtaacacatcac

SEQ ID NO: 79109 - DNA, 17 bp, Homo sapiens
cctggagtacccatcac

SEQ ID NO: 79110 - DNA, 20 bp, Homo sapiens
cccggagtcggagcatcacc

SEQ ID NO: 79111 - DNA, 17 bp, Homo sapiens
cctgggtactcacatca

SEQ ID NO: 79112 - DNA, 23 bp, Homo sapiens
cacttggatggcaacccatcacc

SEQ ID NO: 79113 - DNA, 16 bp, Homo sapiens
cccgggtgtgcatcac

SEQ ID NO: 79114 - DNA, 19 bp, Homo sapiens
cctcggaggtgccctgcat

SEQ ID NO: 79115 - DNA, 23 bp, Homo sapiens
cctggatgctttgcatagttacc

SEQ ID NO: 79116 - DNA, 21 bp, Homo sapiens
cacctggagtactggtccacc

SEQ ID NO: 79117 - DNA, 19 bp, Homo sapiens
cactggagtgcttacccac

SEQ ID NO: 79118 - DNA, 18 bp, Homo sapiens
ggggaaccctgcatcacc

SEQ ID NO: 79119 - DNA, 18 bp, Homo sapiens
ccagagtacttttattgc

SEQ ID NO: 79120 - DNA, 16 bp, Homo sapiens
cggagcctgcatcgcc

SEQ ID NO: 79121 - DNA, 19 bp, Homo sapiens
caccaggagtgcacatcac

SEQ ID NO: 79122 - DNA, 24 bp, Homo sapiens
cacccgggtgttaccatggtcatc

SEQ ID NO: 79123 - DNA, 21 bp, Homo sapiens
cacctgagcagctgcgtcacc

SEQ ID NO: 79124 - DNA, 65 bp, Amsacta moorei entomopoxvirus
ttatttttttttttttattatattgtattatttaatacaatataataaaatatatttaaaaataa

SEQ ID NO: 79125 - DNA, 24 bp, Amsacta moorei entomopoxvirus
tacaatataataaaatatatttaa

SEQ ID NO: 79126 - DNA, 22 bp, Homo sapiens
caatataataaaataatattta

SEQ ID NO: 79127 - DNA, 18 bp, Homo sapiens
cagtataataaaatatat

SEQ ID NO: 79128 - DNA, 19 bp, Homo sapiens
acaatataataaatatatt

SEQ ID NO: 79129 - DNA, 18 bp, Homo sapiens
tacatataataaaatata

SEQ ID NO: 79130 - DNA, 22 bp, Homo sapiens
aatatatataaaatatatttaa

SEQ ID NO: 79131 - DNA, 22 bp, Homo sapiens
acaatatttaaaatatatttaa

SEQ ID NO: 79132 - DNA, 70 bp, Amsacta moorei entomopoxvirus
gtatatatgagattatctgttattttaagactatttatacaccctttaatttaacaattgacatatatac

SEQ ID NO: 79133 - DNA, 24 bp, Amsacta moorei entomopoxvirus
tatatgagattatctgttatttta

SEQ ID NO: 79134 - DNA, 19 bp, Homo sapiens
tatatgagatttttctctt

SEQ ID NO: 79135 - DNA, 24 bp, Homo sapiens
tatatgagaatatatatatatttt

SEQ ID NO: 79136 - DNA, 17 bp, Homo sapiens
tatatgagttatttgct

SEQ ID NO: 79137 - DNA, 25 bp, Homo sapiens
tatatgaaattacagtaatatttta

SEQ ID NO: 79138 - DNA, 24 bp, Homo sapiens
tatatgaatttataaattatttta

SEQ ID NO: 79139 - DNA, 20 bp, Homo sapiens
gatgattgtctgttatttta

SEQ ID NO: 79140 - DNA, 20 bp, Homo sapiens
taagatccactgttatttta

SEQ ID NO: 79141 - DNA, 80 bp, Equine herpesvirus 1
ggaatttgctcgactgaaggtatcaagacgcagtgtacccaacccgacagccaccactctttaaactcccaagcgccgcc

SEQ ID NO: 79142 - DNA, 24 bp, Equine herpesvirus 1
atttgctcgactgaaggtatcaag

SEQ ID NO: 79143 - DNA, 16 bp, Homo sapiens
tttgctcaggtcacca

SEQ ID NO: 79144 - DNA, 80 bp, Zucchini yellow mosaic virus
aggaatgccgtagtcctgtcggaagctttagtgtgagcctctcacggataagctcgagattagactccgtttgcaagcct

SEQ ID NO: 79145 - DNA, 24 bp, Zucchini yellow mosaic virus
tgccgtagtcctgtcggaagcttt

SEQ ID NO: 79146 - DNA, 23 bp, Homo sapiens
gcatcagtcttgttggaagcttt

SEQ ID NO: 79147 - DNA, 23 bp, Homo sapiens
tgtcgtatcttgcccaaagcttt

SEQ ID NO: 79148 - DNA, 17 bp, Homo sapiens
ccgtagtccaaaggctt

SEQ ID NO: 79149 - DNA, 18 bp, Homo sapiens
tgccgtgggcctgtcgga

SEQ ID NO: 79150 - DNA, 68 bp, Human herpesvirus 4
ggtggccggcaaggtgcaatgtttagtgagttacctgtctaacatctcccctttaaagccaaggcacc

SEQ ID NO: 79151 - DNA, 24 bp, Human herpesvirus 4
tctaacatctcccctttaaagcca

SEQ ID NO: 79152 - DNA, 19 bp, Homo sapiens
ctaaccccctttagggcca

SEQ ID NO: 79153 - DNA, 21 bp, Homo sapiens
tccaacatctccctttcttta

SEQ ID NO: 79154 - DNA, 20 bp, Homo sapiens
caacatcttcttttcccttt

SEQ ID NO: 79155 - DNA, 15 bp, Homo sapiens
tctaaatctcaaagc

SEQ ID NO: 79156 - DNA, 18 bp, Homo sapiens
tctaatgtctcccctcta

SEQ ID NO: 79157 - DNA, 19 bp, Homo sapiens
taatgcctcccctttagag

SEQ ID NO: 79158 - DNA, 17 bp, Homo sapiens
tctatatctcccctcca

SEQ ID NO: 79159 - DNA, 20 bp, Homo sapiens
tctaaatcttccccctcagc

SEQ ID NO: 79160 - DNA, 19 bp, Homo sapiens
tctaacatctgttctcacc

SEQ ID NO: 79161 - DNA, 18 bp, Homo sapiens
catctcccctctcctcca

SEQ ID NO: 79162 - DNA, 19 bp, Homo sapiens
caacatctcctcctccggc

SEQ ID NO: 79163 - DNA, 20 bp, Homo sapiens
cctgacatctccctttccca

SEQ ID NO: 79164 - DNA, 25 bp, Homo sapiens
tccaacataaatactcttttaaagc

SEQ ID NO: 79165 - DNA, 24 bp, Homo sapiens
tctggtgactccaagataaagcca

SEQ ID NO: 79166 - DNA, 18 bp, Homo sapiens
cctgacatctccccagcc

SEQ ID NO: 79167 - DNA, 21 bp, Homo sapiens
tctaacatcctcttttatagc

SEQ ID NO: 79168 - DNA, 19 bp, Homo sapiens
tcttacatttcccccaaag

SEQ ID NO: 79169 - DNA, 18 bp, Homo sapiens
cctaacatctcccttacc

SEQ ID NO: 79170 - DNA, 17 bp, Homo sapiens
taacatcttccttaagc

SEQ ID NO: 79171 - DNA, 19 bp, Homo sapiens
caactctttcctttaaagc

SEQ ID NO: 79172 - DNA, 21 bp, Homo sapiens
taacatctgagccagaagcca

SEQ ID NO: 79173 - DNA, 19 bp, Homo sapiens
caaaatctttttaaagcca

SEQ ID NO: 79174 - DNA, 19 bp, Homo sapiens
tctgacatctgccaaagcc

SEQ ID NO: 79175 - DNA, 21 bp, Homo sapiens
acatctcctatgcccaggcca

SEQ ID NO: 79176 - DNA, 21 bp, Homo sapiens
tctaaaatccctttaaagcca

SEQ ID NO: 79177 - DNA, 19 bp, Homo sapiens
tctaacattatctccttca

SEQ ID NO: 79178 - DNA, 22 bp, Homo sapiens
tctagagaactctttaaagcca

SEQ ID NO: 79179 - DNA, 24 bp, Homo sapiens
tctaacacttcctaacgagaaagc

SEQ ID NO: 79180 - DNA, 16 bp, Homo sapiens
taacatccctccagcc

SEQ ID NO: 79181 - DNA, 19 bp, Homo sapiens
tctggcatctccctaaccc

SEQ ID NO: 79182 - DNA, 21 bp, Homo sapiens
tctggatctccccttctccca

SEQ ID NO: 79183 - DNA, 21 bp, Homo sapiens
tctaacatatcccatcaaggc

SEQ ID NO: 79184 - DNA, 18 bp, Homo sapiens
tctaacacctcttccact

SEQ ID NO: 79185 - DNA, 17 bp, Homo sapiens
tctaacattcccctcca

SEQ ID NO: 79186 - DNA, 23 bp, Homo sapiens
tctgtgtctctcaggcaaagcca

SEQ ID NO: 79187 - DNA, 72 bp, Turnip mosaic virus
ggaaatatgtaagtttgttaaagcagccagtgtgactttgtcatgtgtgttgttgttactttctgtattttc

SEQ ID NO: 79188 - DNA, 24 bp, Turnip mosaic virus
ttaaagcagccagtgtgactttgt

SEQ ID NO: 79189 - DNA, 19 bp, Homo sapiens
aaacagcctgcagctttgt

SEQ ID NO: 79190 - DNA, 21 bp, Homo sapiens
ttaaagcaaccaaaactttgt

SEQ ID NO: 79191 - DNA, 19 bp, Homo sapiens
aagcagagagtggctttgt

SEQ ID NO: 79192 - DNA, 18 bp, Homo sapiens
ttaaggcagctgtaactt

SEQ ID NO: 79193 - DNA, 131 bp, Bovine parvovirus
ctctttccaccatcttttagttgtattcttagttatcaataaaggcgcgaagcgccataaaaaattatgtcatatggcgcttcgcgcctttattgataactaagaatacaactaaaagatggtggaaagag

SEQ ID NO: 79194 - DNA, 24 bp, Bovine parvovirus
taactaagaatacaactaaaagat

SEQ ID NO: 79195 - DNA, 16 bp, Homo sapiens
caactaaaactaaaag

SEQ ID NO: 79196 - DNA, 21 bp, Homo sapiens
tactaacacaagctaaaagat

SEQ ID NO: 79197 - DNA, 21 bp, Homo sapiens
aactaagacttcttaaaagat

SEQ ID NO: 79198 - DNA, 63 bp, Lettuce mosaic virus
ctgagggcttttctagtttccgctgtgaggttttacctcgaaggttgctagtctggttttcag

SEQ ID NO: 79199 - DNA, 24 bp, Lettuce mosaic virus
ttctagtttccgctgtgaggtttt

SEQ ID NO: 79200 - DNA, 18 bp, Homo sapiens
ttctagttccataggttt

SEQ ID NO: 79201 - DNA, 22 bp, Homo sapiens
ttctatttctgctgaagatttt

SEQ ID NO: 79202 - DNA, 18 bp, Homo sapiens
ttccagttagtgaggttt

SEQ ID NO: 79203 - DNA, 21 bp, Homo sapiens
ttcagttttcacaaaggtttt

SEQ ID NO: 79204 - DNA, 16 bp, Homo sapiens
ttctagctgtggggtt

SEQ ID NO: 79205 - DNA, 19 bp, Homo sapiens
ttctagtttccagtggttt

SEQ ID NO: 79206 - DNA, 22 bp, Homo sapiens
ttctagttttagctgtgacatt

SEQ ID NO: 79207 - DNA, 100 bp, Paramecium bursaria Chlorella virus 1
attaaatttttaaacattccttaaaatctatgtatctaaacgtgacagtaaatcagtcatcctgacatattctattccattttgtttataaaattttaat

SEQ ID NO: 79208 - DNA, 24 bp, Paramecium bursaria Chlorella virus 1
taaatttttaaacattccttaaaa

SEQ ID NO: 79209 - DNA, 18 bp, Homo sapiens
taaatttttaaacaaccc

SEQ ID NO: 79210 - DNA, 20 bp, Homo sapiens
aatttttaaacatttttaaa

SEQ ID NO: 79211 - DNA, 20 bp, Homo sapiens
taaaattttaaacattctcc

SEQ ID NO: 79212 - DNA, 20 bp, Homo sapiens
ttttaaacattttcctcaaa

SEQ ID NO: 79213 - DNA, 22 bp, Homo sapiens
aatttttaaaatacccttaaaa

SEQ ID NO: 79214 - DNA, 22 bp, Homo sapiens
aaatttttaaatgcccttaaaa

SEQ ID NO: 79215 - DNA, 75 bp, Paramecium bursaria Chlorella virus 1
ttgactttgcatttctcttaacttgtgatttgattctagagtacgttacagggtctgtgggaactgctttttcga

SEQ ID NO: 79216 - DNA, 24 bp, Paramecium bursaria Chlorella virus 1
tacagggtctgtgggaactgcttt

SEQ ID NO: 79217 - DNA, 21 bp, Homo sapiens
gggtagttgggggactgcttt

SEQ ID NO: 79218 - DNA, 17 bp, Homo sapiens
gggtactgcattgcttt

SEQ ID NO: 79219 - DNA, 19 bp, Homo sapiens
cagggtatgtgggggcctt

SEQ ID NO: 79220 - DNA, 16 bp, Homo sapiens
tacaggatggattgct

SEQ ID NO: 79221 - DNA, 23 bp, Homo sapiens
tacagggtctgtgggaattgcct

SEQ ID NO: 79222 - DNA, 19 bp, Homo sapiens
gggggcgcaaaactgcttt

SEQ ID NO: 79223 - DNA, 21 bp, Homo sapiens
tacagagtcactggctgcttt

SEQ ID NO: 79224 - DNA, 18 bp, Homo sapiens
aaggcctgggagctgctt

SEQ ID NO: 79225 - DNA, 19 bp, Homo sapiens
ggcacctgggaactgcttt

SEQ ID NO: 79226 - DNA, 22 bp, Homo sapiens
caggttctgtctaggctgcttt

SEQ ID NO: 79227 - DNA, 20 bp, Homo sapiens
gcatggtgtggaactgcttt

SEQ ID NO: 79228 - DNA, 17 bp, Homo sapiens
gggtcccgggctgcttt

SEQ ID NO: 79229 - DNA, 17 bp, Homo sapiens
gggttgaaaactgcttt

SEQ ID NO: 79230 - DNA, 20 bp, Homo sapiens
tacagggtgttgtgggggct

SEQ ID NO: 79231 - DNA, 17 bp, Homo sapiens
cagggtttgggggagct

SEQ ID NO: 79232 - DNA, 22 bp, Homo sapiens
cagggtttagcttcactgcttt

SEQ ID NO: 79233 - DNA, 63 bp, Scallion mosaic virus
gcgttattggagttaacggttatggtgagactttgtctcgaacaccctaacttttgataatgc

SEQ ID NO: 79234 - DNA, 24 bp, Scallion mosaic virus
tcgaacaccctaacttttgataat

SEQ ID NO: 79235 - DNA, 23 bp, Homo sapiens
tcgaactcctgacctcaggtgat

SEQ ID NO: 79236 - DNA, 21 bp, Homo sapiens
tcgaactcctgaccttgtgat

SEQ ID NO: 79237 - DNA, 21 bp, Homo sapiens
tcgaactcctgacctcatgat

SEQ ID NO: 79238 - DNA, 23 bp, Homo sapiens
tcgaactcctgacctccagtgat

SEQ ID NO: 79239 - DNA, 23 bp, Homo sapiens
tcgaactcctgacctcaagtgat

SEQ ID NO: 79240 - DNA, 21 bp, Homo sapiens
tcgaactcctggcttcatgat

SEQ ID NO: 79241 - DNA, 20 bp, Homo sapiens
tcgaactcctggcctcagat

SEQ ID NO: 79242 - DNA, 22 bp, Homo sapiens
gaactcctaacctcagggtgat

SEQ ID NO: 79243 - DNA, 19 bp, Homo sapiens
gaactcctgaccttgtgat

SEQ ID NO: 79244 - DNA, 23 bp, Homo sapiens
tcgaactcctggcctcaagtgat

SEQ ID NO: 79245 - DNA, 19 bp, Homo sapiens
gaacccctgacctcatgat

SEQ ID NO: 79246 - DNA, 18 bp, Homo sapiens
tcgaactcctgacctctg

SEQ ID NO: 79247 - DNA, 18 bp, Homo sapiens
tcaaacaccttaattttg

SEQ ID NO: 79248 - DNA, 19 bp, Homo sapiens
gaactcctgacctcatgat

SEQ ID NO: 79249 - DNA, 19 bp, Homo sapiens
gaactcctgacctcgtgat

SEQ ID NO: 79250 - DNA, 23 bp, Homo sapiens
tcgaactcctaacctcaggtgat

SEQ ID NO: 79251 - DNA, 21 bp, Homo sapiens
gaactcctaacctcaagtgat

SEQ ID NO: 79252 - DNA, 21 bp, Homo sapiens
tcgaactcctgacctcgtgat

SEQ ID NO: 79253 - DNA, 22 bp, Homo sapiens
tcgaactcctgactccggtgat

SEQ ID NO: 79254 - DNA, 19 bp, Homo sapiens
tcgaacacacagttgataa

SEQ ID NO: 79255 - DNA, 20 bp, Homo sapiens
tcgaactcctgacttgtgat

SEQ ID NO: 79256 - DNA, 21 bp, Homo sapiens
tcgaactcctgatctcatgat

SEQ ID NO: 79257 - DNA, 23 bp, Homo sapiens
tcgaactcctggcctcaggtgat

SEQ ID NO: 79258 - DNA, 22 bp, Homo sapiens
tcgaactcctgactcaggtgat

SEQ ID NO: 79259 - DNA, 23 bp, Homo sapiens
tcgaactcctgacctgaagtgat

SEQ ID NO: 79260 - DNA, 17 bp, Homo sapiens
aacaccctaattcacaa

SEQ ID NO: 79261 - DNA, 22 bp, Homo sapiens
gaacatccaacagtttgataat

SEQ ID NO: 79262 - DNA, 21 bp, Homo sapiens
tcgaactcctgacatcgtgat

SEQ ID NO: 79263 - DNA, 17 bp, Homo sapiens
aacaccctaacgatgat

SEQ ID NO: 79264 - DNA, 23 bp, Homo sapiens
tcgaactcctgacctcaaatgat

SEQ ID NO: 79265 - DNA, 23 bp, Homo sapiens
tcgaactcctgacttcaggtgat

SEQ ID NO: 79266 - DNA, 19 bp, Homo sapiens
gaactcctgactttgtgat

SEQ ID NO: 79267 - DNA, 20 bp, Homo sapiens
tcgaactcctgacctcagat

SEQ ID NO: 79268 - DNA, 18 bp, Homo sapiens
gaaaccctaattcccaat

SEQ ID NO: 79269 - DNA, 23 bp, Homo sapiens
tcgaactcctgacctcacgtgat

SEQ ID NO: 79270 - DNA, 21 bp, Homo sapiens
gaactcctaacctcaggtgat

SEQ ID NO: 79271 - DNA, 24 bp, Homo sapiens
tcagacatcctagtttccaataat

SEQ ID NO: 79272 - DNA, 23 bp, Homo sapiens
tcgaactcctgaccttaggtgat

SEQ ID NO: 79273 - DNA, 21 bp, Homo sapiens
tcgaactcctggccttgtgat

SEQ ID NO: 79274 - DNA, 21 bp, Homo sapiens
tcgaactcctaacctcgtgat

SEQ ID NO: 79275 - DNA, 20 bp, Homo sapiens
tcgaactcctgaccccagat

SEQ ID NO: 79276 - DNA, 23 bp, Homo sapiens
tcgaacccctgacctcaggtgat

SEQ ID NO: 79277 - DNA, 21 bp, Homo sapiens
tcgaactcctgacttcatgat

SEQ ID NO: 79278 - DNA, 21 bp, Homo sapiens
tcgaactcctgatctcgtgat

SEQ ID NO: 79279 - DNA, 23 bp, Homo sapiens
tcgaactcctgacctcaggtaat

SEQ ID NO: 79280 - DNA, 18 bp, Homo sapiens
tcgaactcctgacctccg

SEQ ID NO: 79281 - DNA, 23 bp, Homo sapiens
tcgaactcctgacttgaggtgat

SEQ ID NO: 79282 - DNA, 23 bp, Homo sapiens
tcgaacccctgacatcaggtgat

SEQ ID NO: 79283 - DNA, 21 bp, Homo sapiens
tcgaactcctgaccgcatgat

SEQ ID NO: 79284 - DNA, 18 bp, Homo sapiens
tcggggccctaactttca

SEQ ID NO: 79285 - DNA, 21 bp, Homo sapiens
tcgaactcctgatcttgtgat

SEQ ID NO: 79286 - DNA, 21 bp, Homo sapiens
gaacaccctgacttttcaata

SEQ ID NO: 79287 - DNA, 17 bp, Homo sapiens
gaaatcctaacccttaa

SEQ ID NO: 79288 - DNA, 22 bp, Homo sapiens
tcgaactcctgacctcagtgat

SEQ ID NO: 79289 - DNA, 20 bp, Homo sapiens
gaacccctgacctcagtgat

SEQ ID NO: 79290 - DNA, 23 bp, Homo sapiens
tcgaactcctgacctaaggtgat

SEQ ID NO: 79291 - DNA, 18 bp, Homo sapiens
tcgaactcctgaccttcg

SEQ ID NO: 79292 - DNA, 23 bp, Homo sapiens
gaacacccctggtctatgggata

SEQ ID NO: 79293 - DNA, 23 bp, Homo sapiens
tcgaactcctaacctcaagtgat

SEQ ID NO: 79294 - DNA, 19 bp, Homo sapiens
gaacccctgacctcgtgat

SEQ ID NO: 79295 - DNA, 21 bp, Homo sapiens
gaacaccctgacaggaatgat

SEQ ID NO: 79296 - DNA, 18 bp, Homo sapiens
gaactcctgacctcagat

SEQ ID NO: 79297 - DNA, 87 bp, Human adenovirus C
gtggataaattcgcaagggtatcatggcggacgaccggggttcgaaccccggatccggccgtccgccgtgatccatgcggttaccgc

SEQ ID NO: 79298 - DNA, 24 bp, Human adenovirus C
tccgccgtgatccatgcggttacc

SEQ ID NO: 79299 - DNA, 18 bp, Homo sapiens
cctgtcgtgatccacagt

SEQ ID NO: 79300 - DNA, 69 bp, Camelpox virus
tagacgaccggtttatcattaattaatacaatgtctaaattccataacatattacaaaatcgccgtcta

SEQ ID NO: 79301 - DNA, 24 bp, Camelpox virus
accggtttatcattaattaataca

SEQ ID NO: 79302 - DNA, 20 bp, Homo sapiens
ggtttatcttgcctgataca

SEQ ID NO: 79303 - DNA, 20 bp, Homo sapiens
ggctttaatccattaataca

SEQ ID NO: 79304 - DNA, 23 bp, Homo sapiens
ggtttatcagttacataagtaca

SEQ ID NO: 79305 - DNA, 22 bp, Homo sapiens
ccgggtgtcattaattaatgca

SEQ ID NO: 79306 - DNA, 21 bp, Homo sapiens
ggtttatcattctgaagtaca

SEQ ID NO: 79307 - DNA, 76 bp, Fowl adenovirus D
gcaggtgtcaccgaggttgtcgctgtcccatcttatgtgaaaagtggacgaataacgagagggagacgagatctgc

SEQ ID NO: 79308 - DNA, 24 bp, Fowl adenovirus D
aggttgtcgctgtcccatcttatg

SEQ ID NO: 79309 - DNA, 22 bp, Homo sapiens
aggttgcgttgtcccattttac

SEQ ID NO: 79310 - DNA, 21 bp, Homo sapiens
gggtctgggtcccatcttatg

SEQ ID NO: 79311 - DNA, 16 bp, Homo sapiens
ggctgtcgctgttctt

SEQ ID NO: 79312 - DNA, 60 bp, Human herpesvirus 6
cacacccaagaacaacgatatggatgatcacgacaacaataatatcgttttttctttgtg

SEQ ID NO: 79313 - DNA, 21 bp, Human herpesvirus 6
taatatcgttttttctttgtg

SEQ ID NO: 79314 - DNA, 20 bp, Homo sapiens
aacatacttttttctttgtg

SEQ ID NO: 79315 - DNA, 16 bp, Homo sapiens
tatcgttttctttatg

SEQ ID NO: 79316 - DNA, 18 bp, Homo sapiens
tgatcatccttctttgtg

SEQ ID NO: 79317 - DNA, 21 bp, Homo sapiens
caatgtcgttacatctttgtg

SEQ ID NO: 79318 - DNA, 124 bp, Ictalurid herpesvirus 1
tttgaaaaagagggagggggtggtaatttatgtgttttttaaggaagtggaagagactctcatatgtatacacaagttcactttatttcagatacattatcaactcatcaagcttaaattcaaa

SEQ ID NO: 79319 - DNA, 24 bp, Ictalurid herpesvirus 1
tacattatcaactcatcaagctta

SEQ ID NO: 79320 - DNA, 16 bp, Homo sapiens
cattatcaactggctt

SEQ ID NO: 79321 - DNA, 21 bp, Homo sapiens
tacattattaactttttcaag

SEQ ID NO: 79322 - DNA, 17 bp, Homo sapiens
cattgtccatcaagctt

SEQ ID NO: 79323 - DNA, 19 bp, Homo sapiens
tacattcattctcaagctt

SEQ ID NO: 79324 - DNA, 23 bp, Homo sapiens
tacattatcaatacaggcaactt

SEQ ID NO: 79325 - DNA, 19 bp, Homo sapiens
ttatcaattctcaagccta

SEQ ID NO: 79326 - DNA, 71 bp, Black queen cell virus
ccaacaatgtgatcttgcttgcggaggcaaaatttgcacagtataaaatctgcaagtagtgctattgttgg

SEQ ID NO: 79327 - DNA, 24 bp, Black queen cell virus
aacaatgtgatcttgcttgcggag

SEQ ID NO: 79328 - DNA, 19 bp, Homo sapiens
aatgtgatctcggggtggg

SEQ ID NO: 79329 - DNA, 24 bp, Homo sapiens
atgtgatcttgttaaaaactggag

SEQ ID NO: 79330 - DNA, 17 bp, Homo sapiens
atgtgatcatacaggag

SEQ ID NO: 79331 - DNA, 22 bp, Homo sapiens
acaatgtgatgttagggactgg

SEQ ID NO: 79332 - DNA, 21 bp, Homo sapiens
actatgtgatcttgcacaagg

SEQ ID NO: 79333 - DNA, 17 bp, Homo sapiens
atgtaatcttgctttgg

SEQ ID NO: 79334 - DNA, 19 bp, Homo sapiens
acaatgtgttttgctctgg

SEQ ID NO: 79335 - DNA, 22 bp, Homo sapiens
acagtgtgatccttgtttgtgc

SEQ ID NO: 79336 - DNA, 18 bp, Homo sapiens
aacaatgtggttcttgct

SEQ ID NO: 79337 - DNA, 16 bp, Homo sapiens
aatgtgatcttgtcag

SEQ ID NO: 79338 - DNA, 107 bp, Molluscum contagiosum virus
gcacgtgccgtgctgtctctcgcccgacttttcgcgccgcgggcacatggacggcgcctttgccacgccagcccgacttctcgcgcgactggcacgcgccgcgcggc

SEQ ID NO: 79339 - DNA, 24 bp, Molluscum contagiosum virus
ttcgcgccgcgggcacatggacgg

SEQ ID NO: 79340 - DNA, 19 bp, Homo sapiens
cgcgccgcgggccgggcgg

SEQ ID NO: 79341 - DNA, 19 bp, Homo sapiens
ttcccgccgcggggggacg

SEQ ID NO: 79342 - DNA, 23 bp, Homo sapiens
tccgcgccgtggagtccgggcgg

SEQ ID NO: 79343 - DNA, 66 bp, Yam mosaic virus
tctttacttttaagaatgaatgagatgagggtggccctcaaatctcttcctcttatcgtgtgaaga

SEQ ID NO: 79344 - DNA, 24 bp, Yam mosaic virus
tttaagaatgaatgagatgagggt

SEQ ID NO: 79345 - DNA, 22 bp, Homo sapiens
tttaagaattgtaagtgggggt

SEQ ID NO: 79346 - DNA, 15 bp, Homo sapiens
gaagaaagatgaggg

SEQ ID NO: 79347 - DNA, 21 bp, Homo sapiens
tttaagaagagtgaattaggg

SEQ ID NO: 79348 - DNA, 19 bp, Homo sapiens
cttaaggatgagatgaggg

SEQ ID NO: 79349 - DNA, 18 bp, Homo sapiens
cttaggaatgaatgagat

SEQ ID NO: 79350 - DNA, 24 bp, Homo sapiens
tttaggaatgaatcagtgatatgt

SEQ ID NO: 79351 - DNA, 19 bp, Homo sapiens
gaatgaatgggaaaagggt

SEQ ID NO: 79352 - DNA, 18 bp, Homo sapiens
tttagtaatgaatgagtg

SEQ ID NO: 79353 - DNA, 16 bp, Homo sapiens
gaggaatgagagaggg

SEQ ID NO: 79354 - DNA, 21 bp, Homo sapiens
tttaaaacattggatgagggt

SEQ ID NO: 79355 - DNA, 71 bp, Yam mosaic virus
ctcatctttggtgtgattaggtgtggtgtaactttgttacgtatcctttcacatttgattatgagatagag

SEQ ID NO: 79356 - DNA, 24 bp, Yam mosaic virus
ttcacatttgattatgagatagag

SEQ ID NO: 79357 - DNA, 18 bp, Homo sapiens
tttcattcctgagataga

SEQ ID NO: 79358 - DNA, 20 bp, Homo sapiens
ttcacatctatgagatagag

SEQ ID NO: 79359 - DNA, 24 bp, Homo sapiens
ttcacatttggattcatcttagag

SEQ ID NO: 79360 - DNA, 19 bp, Homo sapiens
tcacatttgatttctgtag

SEQ ID NO: 79361 - DNA, 23 bp, Homo sapiens
ttcacctttgctaagagatagag

SEQ ID NO: 79362 - DNA, 20 bp, Homo sapiens
catttgacttagaatcagag

SEQ ID NO: 79363 - DNA, 19 bp, Homo sapiens
atttatttatgagatggag

SEQ ID NO: 79364 - DNA, 18 bp, Homo sapiens
tttaattactgagataga

SEQ ID NO: 79365 - DNA, 17 bp, Homo sapiens
tcacattcttgaggtag

SEQ ID NO: 79366 - DNA, 15 bp, Homo sapiens
atttgtgagatagag

SEQ ID NO: 79367 - DNA, 18 bp, Homo sapiens
tctctttgtgagatagag

SEQ ID NO: 79368 - DNA, 60 bp, Soybean dwarf virus
gtaaccatagtagtaataatagtagtagcagttagtttattagactactctagttcatac

SEQ ID NO: 79369 - DNA, 21 bp, Soybean dwarf virus
ttagactactctagttcatac

SEQ ID NO: 79370 - DNA, 20 bp, Homo sapiens
ctagactattccccctcata

SEQ ID NO: 79371 - DNA, 17 bp, Homo sapiens
aactgctctgctcatac

SEQ ID NO: 79372 - DNA, 17 bp, Homo sapiens
ttagactactcattcac

SEQ ID NO: 79373 - DNA, 21 bp, Homo sapiens
ttaaactctagtagttcatac

SEQ ID NO: 79374 - DNA, 18 bp, Homo sapiens
tcagcactcttagttcat

SEQ ID NO: 79375 - DNA, 19 bp, Homo sapiens
ttagtaacctggttcatac

SEQ ID NO: 79376 - DNA, 16 bp, Homo sapiens
ttagactactgtgcac

SEQ ID NO: 79377 - DNA, 20 bp, Homo sapiens
tcagattctcaagttcatac

SEQ ID NO: 79378 - DNA, 22 bp, Homo sapiens
ttagactacccattccccatac

SEQ ID NO: 79379 - DNA, 18 bp, Homo sapiens
tcagactacccctttcat

SEQ ID NO: 79380 - DNA, 19 bp, Homo sapiens
ttagactaattgttcatac

SEQ ID NO: 79381 - DNA, 20 bp, Homo sapiens
ttagactaatacactcatac

SEQ ID NO: 79382 - DNA, 17 bp, Homo sapiens
ttagactctagtttata

SEQ ID NO: 79383 - DNA, 122 bp, Soil-borne cereal mosaic virus
ctgggttatcactatctcgaaacttagcagagactaacatctcgctgctctaggcctgcaatgcaataaatcctaggtagtcagctgttagcgtgtgacgttgaaagatagtgttatttcgg

SEQ ID NO: 79384 - DNA, 24 bp, Soil-borne cereal mosaic virus
tagcgtgtgacgttgaaagatagt

SEQ ID NO: 79385 - DNA, 25 bp, Homo sapiens
tagtgtgtgacgttaagagcaaagt

SEQ ID NO: 79386 - DNA, 61 bp, Human herpesvirus 3
acaggcgtgtttatgtacattaaagtatttgtggtttttattgactgggcgtttcgtttgt

SEQ ID NO: 79387 - DNA, 21 bp, Human herpesvirus 3
ttgactgggcgtttcgtttgt

SEQ ID NO: 79388 - DNA, 20 bp, Homo sapiens
ttaactgggtgtggtcctgt

SEQ ID NO: 79389 - DNA, 24 bp, Homo sapiens
ttaactgggtacccaattgtttgt

SEQ ID NO: 79390 - DNA, 16 bp, Homo sapiens
ttgactgggtctttgc

SEQ ID NO: 79391 - DNA, 19 bp, Homo sapiens
ttcactaggtttcgtttgt

SEQ ID NO: 79392 - DNA, 17 bp, Homo sapiens
tgattgggagtgtttgt

SEQ ID NO: 79393 - DNA, 22 bp, Homo sapiens
ttgactgggcctgagattttgt

SEQ ID NO: 79394 - DNA, 20 bp, Homo sapiens
ttggctgagcgttcacctgt

SEQ ID NO: 79395 - DNA, 21 bp, Homo sapiens
ttcacctgcagttttgtttgt

SEQ ID NO: 79396 - DNA, 69 bp, Human herpesvirus 3
acgtgcttattcaacgctctttgggatttgaatcatcgtaaacgtagcgtccctaccagttgagcgcgt

SEQ ID NO: 79397 - DNA, 24 bp, Human herpesvirus 3
tagcgtccctaccagttgagcgcg

SEQ ID NO: 79398 - DNA, 21 bp, Homo sapiens
agcagctgccagttgagtgcg

SEQ ID NO: 79399 - DNA, 20 bp, Homo sapiens
agtgtccctacaaagaggcg

SEQ ID NO: 79400 - DNA, 18 bp, Homo sapiens
tagcgtccctagcaggcg

SEQ ID NO: 79401 - DNA, 17 bp, Homo sapiens
taggtccctaccaagtg

SEQ ID NO: 79402 - DNA, 21 bp, Homo sapiens
gcgtccctgtcagcgcccgcg

SEQ ID NO: 79403 - DNA, 60 bp, Human herpesvirus 5
gcctcagtctctcggtgcgtggaccagacggcgtccatgcaccgagggcagaactggtgc

SEQ ID NO: 79404 - DNA, 24 bp, Human herpesvirus 5
tctctcggtgcgtggaccagacgg

SEQ ID NO: 79405 - DNA, 19 bp, Homo sapiens
tctctcggtgcaggaggcg

SEQ ID NO: 79406 - DNA, 16 bp, Homo sapiens
tctctcggtggtgcag

SEQ ID NO: 79407 - DNA, 21 bp, Homo sapiens
cctcggtgggcccccaggcgg

SEQ ID NO: 79408 - DNA, 22 bp, Homo sapiens
tctgccggtgtggaccaggtgg

SEQ ID NO: 79409 - DNA, 90 bp, Chinese wheat mosaic virus
ctgatactttggaactgtatactaagccaagtttaggcccgttatgcgataaatcctaggttggtggagaatacggtttcgttgttgaag

SEQ ID NO: 79410 - DNA, 24 bp, Chinese wheat mosaic virus
aactgtatactaagccaagtttag

SEQ ID NO: 79411 - DNA, 18 bp, Homo sapiens
tgtatacttaagtcccag

SEQ ID NO: 79412 - DNA, 20 bp, Homo sapiens
tgacatacagccaagtttag

SEQ ID NO: 79413 - DNA, 16 bp, Homo sapiens
tatatactccaagttt

SEQ ID NO: 79414 - DNA, 16 bp, Homo sapiens
tgtatactaaggttta

SEQ ID NO: 79415 - DNA, 22 bp, Homo sapiens
actgtataccaggtctatctag

SEQ ID NO: 79416 - DNA, 16 bp, Homo sapiens
ctgtatacaaggttta

SEQ ID NO: 79417 - DNA, 21 bp, Homo sapiens
aactgtagtgcctaagtttag

SEQ ID NO: 79418 - DNA, 23 bp, Homo sapiens
aactgtatgctgagcccttatct

SEQ ID NO: 79419 - DNA, 100 bp, Taura syndrome virus
tagcaccacccgatcgtaaactccatgtattggttacccatctgcatcgaaaactctccgaacactaggtgcagtaaggctttcatggagtggtttgcta

SEQ ID NO: 79420 - DNA, 20 bp, Taura syndrome virus
tttcatggagtggtttgcta

SEQ ID NO: 79421 - DNA, 18 bp, Homo sapiens
tttaatggagtagaacta

SEQ ID NO: 79422 - DNA, 20 bp, Homo sapiens
tttcatgaagcatgttgcta

SEQ ID NO: 79423 - DNA, 17 bp, Homo sapiens
tttcagggaggcctgct

SEQ ID NO: 79424 - DNA, 17 bp, Homo sapiens
tctcatgggggtctgct

SEQ ID NO: 79425 - DNA, 15 bp, Homo sapiens
cttcatggagctgct

SEQ ID NO: 79426 - DNA, 21 bp, Homo sapiens
tctcatggagatatattgcta

SEQ ID NO: 79427 - DNA, 16 bp, Homo sapiens
tttcatgggtgaagcc

SEQ ID NO: 79428 - DNA, 16 bp, Homo sapiens
ttccatggggtcccct

SEQ ID NO: 79429 - DNA, 20 bp, Homo sapiens
tttcatgggttgtcctgcta

SEQ ID NO: 79430 - DNA, 16 bp, Homo sapiens
tttcatggtgagtgct

SEQ ID NO: 79431 - DNA, 16 bp, Homo sapiens
tttcatggaataaact

SEQ ID NO: 79432 - DNA, 16 bp, Homo sapiens
tttcaggaggcctgct

SEQ ID NO: 79433 - DNA, 16 bp, Homo sapiens
tttcctggggcttact

SEQ ID NO: 79434 - DNA, 20 bp, Homo sapiens
tttcatggaatccactgcta

SEQ ID NO: 79435 - DNA, 19 bp, Homo sapiens
tttcatggaagtatatcta

SEQ ID NO: 79436 - DNA, 15 bp, Homo sapiens
cttcatggaactgct

SEQ ID NO: 79437 - DNA, 17 bp, Homo sapiens
tttcacaaggtttgcta

SEQ ID NO: 79438 - DNA, 18 bp, Homo sapiens
tttcatgaagtatcagcc

SEQ ID NO: 79439 - DNA, 17 bp, Homo sapiens
tttgatggagtgaggct

SEQ ID NO: 79440 - DNA, 15 bp, Homo sapiens
tttctggagtggact

SEQ ID NO: 79441 - DNA, 15 bp, Homo sapiens
tttcatgaatctgct

SEQ ID NO: 79442 - DNA, 20 bp, Homo sapiens
tttcatggtgtcacgatttg

SEQ ID NO: 79443 - DNA, 20 bp, Homo sapiens
ttccatgggccccacttgct

SEQ ID NO: 79444 - DNA, 18 bp, Homo sapiens
tttcaggaacttggtgct

SEQ ID NO: 79445 - DNA, 18 bp, Homo sapiens
tttcttggtgacttgcta

SEQ ID NO: 79446 - DNA, 22 bp, Homo sapiens
tttcatgagggcctcggtgcta

SEQ ID NO: 79447 - DNA, 18 bp, Homo sapiens
tttcctggagtggagact

SEQ ID NO: 79448 - DNA, 16 bp, Homo sapiens
tttcactggagttgcc

SEQ ID NO: 79449 - DNA, 18 bp, Homo sapiens
tttcatggagattctttg

SEQ ID NO: 79450 - DNA, 20 bp, Homo sapiens
tctcatggggttttggtttg

SEQ ID NO: 79451 - DNA, 18 bp, Homo sapiens
tttcatagggtgccctct

SEQ ID NO: 79452 - DNA, 17 bp, Homo sapiens
tttcatgggtgcaaacc

SEQ ID NO: 79453 - DNA, 17 bp, Homo sapiens
tttcatggtgggatgct

SEQ ID NO: 79454 - DNA, 18 bp, Homo sapiens
tctcatgcttatttgcta

SEQ ID NO: 79455 - DNA, 17 bp, Homo sapiens
tttcaaggagggagcta

SEQ ID NO: 79456 - DNA, 17 bp, Homo sapiens
tttcatggcctctgcta

SEQ ID NO: 79457 - DNA, 17 bp, Homo sapiens
cttcatggagtgaagct

SEQ ID NO: 79458 - DNA, 19 bp, Homo sapiens
tttctgttatggtttgcta

SEQ ID NO: 79459 - DNA, 16 bp, Homo sapiens
tcatgaagatttgcta

SEQ ID NO: 79460 - DNA, 20 bp, Homo sapiens
tttctgaatcaggtttgcta

SEQ ID NO: 79461 - DNA, 19 bp, Homo sapiens
tttcatggatggggaaact

SEQ ID NO: 79462 - DNA, 19 bp, Homo sapiens
ttcatggagcgagaatttg

SEQ ID NO: 79463 - DNA, 20 bp, Homo sapiens
tttcatggaagtatgagcta

SEQ ID NO: 79464 - DNA, 18 bp, Homo sapiens
tttcatgaaacggtgcta

SEQ ID NO: 79465 - DNA, 19 bp, Homo sapiens
tttcatggaagcagcagct

SEQ ID NO: 79466 - DNA, 17 bp, Homo sapiens
tttcatgatttttgcta

SEQ ID NO: 79467 - DNA, 18 bp, Homo sapiens
tttcatgaagtacaaact

SEQ ID NO: 79468 - DNA, 20 bp, Homo sapiens
tttcatgagaacagtttgct

SEQ ID NO: 79469 - DNA, 19 bp, Homo sapiens
ttcatgatttatgtttgct

SEQ ID NO: 79470 - DNA, 19 bp, Homo sapiens
cttcatggagtgactcact

SEQ ID NO: 79471 - DNA, 21 bp, Homo sapiens
tttcctggagtgacgggttta

SEQ ID NO: 79472 - DNA, 18 bp, Homo sapiens
tttctgaagcatttgcta

SEQ ID NO: 79473 - DNA, 15 bp, Homo sapiens
tttcatggtggcgct

SEQ ID NO: 79474 - DNA, 19 bp, Homo sapiens
tttcatgagagtaggcttg

SEQ ID NO: 79475 - DNA, 20 bp, Homo sapiens
tttgatggagtggtggtgct

SEQ ID NO: 79476 - DNA, 17 bp, Homo sapiens
tttctgaaaagtttgct

SEQ ID NO: 79477 - DNA, 19 bp, Homo sapiens
tttcatggtagatccagct

SEQ ID NO: 79478 - DNA, 17 bp, Homo sapiens
tctcatggggctggcta

SEQ ID NO: 79479 - DNA, 19 bp, Homo sapiens
tttcatgggtttggagcta

SEQ ID NO: 79480 - DNA, 18 bp, Homo sapiens
tttcaggagtgacagttg

SEQ ID NO: 79481 - DNA, 15 bp, Homo sapiens
tttcatggggtttct

SEQ ID NO: 79482 - DNA, 16 bp, Homo sapiens
tcatggagatgggcta

SEQ ID NO: 79483 - DNA, 21 bp, Homo sapiens
tttcataggagaaagctgcta

SEQ ID NO: 79484 - DNA, 17 bp, Homo sapiens
tttcatgagaatgagct

SEQ ID NO: 79485 - DNA, 18 bp, Homo sapiens
tttcatgggccagctgct

SEQ ID NO: 79486 - DNA, 18 bp, Homo sapiens
ttcatgataaagtttgct

SEQ ID NO: 79487 - DNA, 68 bp, Papaya ringspot virus
attagaatacagagtggctgcgccaccgcttctattttacagtgagggtagccctccgtgcttttagt

SEQ ID NO: 79488 - DNA, 24 bp, Papaya ringspot virus
tagaatacagagtggctgcgccac

SEQ ID NO: 79489 - DNA, 19 bp, Homo sapiens
gattacaggtgtgcgccac

SEQ ID NO: 79490 - DNA, 19 bp, Homo sapiens
gattacaggcatgcgccac

SEQ ID NO: 79491 - DNA, 19 bp, Homo sapiens
gattacaggtatgtgctac

SEQ ID NO: 79492 - DNA, 19 bp, Homo sapiens
gactacaggtgtgtgccac

SEQ ID NO: 79493 - DNA, 19 bp, Homo sapiens
gactacaggtgcgcgccac

SEQ ID NO: 79494 - DNA, 18 bp, Homo sapiens
tagagtgcagatagctgc

SEQ ID NO: 79495 - DNA, 19 bp, Homo sapiens
gaatacaggtgtgcgccac

SEQ ID NO: 79496 - DNA, 21 bp, Homo sapiens
tagaatacagagtgcaggcac

SEQ ID NO: 79497 - DNA, 19 bp, Homo sapiens
gattacaggtatgcgccac

SEQ ID NO: 79498 - DNA, 18 bp, Homo sapiens
tagaatcagagtggtggc

SEQ ID NO: 79499 - DNA, 19 bp, Homo sapiens
gattacaggtgcgcgccac

SEQ ID NO: 79500 - DNA, 19 bp, Homo sapiens
gattacaggcacgcgccac

SEQ ID NO: 79501 - DNA, 19 bp, Homo sapiens
gatcacaggcatgtgccac

SEQ ID NO: 79502 - DNA, 20 bp, Homo sapiens
gaattacaggcatgtgccac

SEQ ID NO: 79503 - DNA, 19 bp, Homo sapiens
gatcacaggcacgtgccac

SEQ ID NO: 79504 - DNA, 19 bp, Homo sapiens
gactacaggtgtgcgccac

SEQ ID NO: 79505 - DNA, 19 bp, Homo sapiens
gactacaggcatgcgccac

SEQ ID NO: 79506 - DNA, 19 bp, Homo sapiens
gattacaggcgtgtgccac

SEQ ID NO: 79507 - DNA, 19 bp, Homo sapiens
gactacaggcgtgcgccac

SEQ ID NO: 79508 - DNA, 19 bp, Homo sapiens
gactacaggcgtgtgccac

SEQ ID NO: 79509 - DNA, 19 bp, Homo sapiens
gattacaggcatgtgccac

SEQ ID NO: 79510 - DNA, 19 bp, Homo sapiens
gactacaggcacgtgccac

SEQ ID NO: 79511 - DNA, 20 bp, Homo sapiens
gaactacgggtgtgtgccac

SEQ ID NO: 79512 - DNA, 20 bp, Homo sapiens
tagagtaacagttgtgctgc

SEQ ID NO: 79513 - DNA, 19 bp, Homo sapiens
gattacagcgatgcgctac

SEQ ID NO: 79514 - DNA, 19 bp, Homo sapiens
gactacaggcaggcgtcac

SEQ ID NO: 79515 - DNA, 19 bp, Homo sapiens
gattacaggcttgcgccac

SEQ ID NO: 79516 - DNA, 19 bp, Homo sapiens
gattacagatgtgtgccgc

SEQ ID NO: 79517 - DNA, 19 bp, Homo sapiens
gactacaggtatgcgccac

SEQ ID NO: 79518 - DNA, 19 bp, Homo sapiens
gattacaggcgggtgccac

SEQ ID NO: 79519 - DNA, 18 bp, Homo sapiens
gattacaggtatgtgcca

SEQ ID NO: 79520 - DNA, 19 bp, Homo sapiens
gactacaggcatgtgccac

SEQ ID NO: 79521 - DNA, 18 bp, Homo sapiens
gaatacagaatgccctgc

SEQ ID NO: 79522 - DNA, 19 bp, Homo sapiens
gattacaggcgcgtgccac

SEQ ID NO: 79523 - DNA, 18 bp, Homo sapiens
gattacaggtgggcgcca

SEQ ID NO: 79524 - DNA, 20 bp, Homo sapiens
gaattacaggtgtgcgctac

SEQ ID NO: 79525 - DNA, 21 bp, Homo sapiens
tagaatataggcatatgccac

SEQ ID NO: 79526 - DNA, 18 bp, Homo sapiens
gactacaggtgtgtgcca

SEQ ID NO: 79527 - DNA, 19 bp, Homo sapiens
gattacaggtgtgtgccac

SEQ ID NO: 79528 - DNA, 19 bp, Homo sapiens
gattacaggtgagcgccac

SEQ ID NO: 79529 - DNA, 17 bp, Homo sapiens
tagaatacaggtgacca

SEQ ID NO: 79530 - DNA, 19 bp, Homo sapiens
gactataggtgtgtgccac

SEQ ID NO: 79531 - DNA, 19 bp, Homo sapiens
gattacaggcgcgcgccac

SEQ ID NO: 79532 - DNA, 20 bp, Homo sapiens
gaactacaggcatgcgccac

SEQ ID NO: 79533 - DNA, 17 bp, Homo sapiens
tagatacagtgtgctac

SEQ ID NO: 79534 - DNA, 20 bp, Homo sapiens
gaattacaggcatgcgccac

SEQ ID NO: 79535 - DNA, 19 bp, Homo sapiens
gactacagatgggtgccac

SEQ ID NO: 79536 - DNA, 16 bp, Homo sapiens
tacaggcatgcgccac

SEQ ID NO: 79537 - DNA, 19 bp, Homo sapiens
gactacaggcgcgtgccac

SEQ ID NO: 79538 - DNA, 19 bp, Homo sapiens
gattacaggcaggcgccac

SEQ ID NO: 79539 - DNA, 19 bp, Homo sapiens
gattacaggcgtgcgctac

SEQ ID NO: 79540 - DNA, 20 bp, Homo sapiens
gattacaggcaatgcgccac

SEQ ID NO: 79541 - DNA, 19 bp, Homo sapiens
gattacaggtgcgtgccac

SEQ ID NO: 79542 - DNA, 20 bp, Homo sapiens
gaaagcagagtggctgctgc

SEQ ID NO: 79543 - DNA, 17 bp, Homo sapiens
tagatacagagtgccca

SEQ ID NO: 79544 - DNA, 19 bp, Homo sapiens
gattacaggggcccgccac

SEQ ID NO: 79545 - DNA, 20 bp, Homo sapiens
gaactacaggcgtgcgccac

SEQ ID NO: 79546 - DNA, 17 bp, Homo sapiens
tagatacagagtgtcta

SEQ ID NO: 79547 - DNA, 21 bp, Homo sapiens
gattacaggcacatgcgccac

SEQ ID NO: 79548 - DNA, 18 bp, Homo sapiens
taggacacagagtgactg

SEQ ID NO: 79549 - DNA, 21 bp, Homo sapiens
tagaggcagaggccacgccac

SEQ ID NO: 79550 - DNA, 19 bp, Homo sapiens
gattacaggcgtgcgccac

SEQ ID NO: 79551 - DNA, 19 bp, Homo sapiens
gaatacagaggcctgccac

SEQ ID NO: 79552 - DNA, 19 bp, Homo sapiens
gattacagacgcgcgccac

SEQ ID NO: 79553 - DNA, 19 bp, Homo sapiens
gactacaggtgtgtgtcgc

SEQ ID NO: 79554 - DNA, 23 bp, Homo sapiens
tacggagtggggaactgtgtcac

SEQ ID NO: 79555 - DNA, 19 bp, Homo sapiens
gactacgggggcccgccac

SEQ ID NO: 79556 - DNA, 19 bp, Homo sapiens
gaatacaatataggcgcca

SEQ ID NO: 79557 - DNA, 19 bp, Homo sapiens
gaatacaggcacgtgccac

SEQ ID NO: 79558 - DNA, 20 bp, Homo sapiens
gaattacaggtatgcgccac

SEQ ID NO: 79559 - DNA, 19 bp, Homo sapiens
gattacaggcacgtgccac

SEQ ID NO: 79560 - DNA, 18 bp, Homo sapiens
gattacaggcatgcgcca

SEQ ID NO: 79561 - DNA, 19 bp, Homo sapiens
gactacaggcgggtgccac

SEQ ID NO: 79562 - DNA, 21 bp, Homo sapiens
gaaggggagtggctgtgctac

SEQ ID NO: 79563 - DNA, 19 bp, Homo sapiens
tagaatacaggtgaaacta

SEQ ID NO: 79564 - DNA, 20 bp, Homo sapiens
gaattacaggcacgcgccac

SEQ ID NO: 79565 - DNA, 19 bp, Homo sapiens
gaatacaggcatgtgccac

SEQ ID NO: 79566 - DNA, 20 bp, Homo sapiens
gaattacaggcgtgtgctac

SEQ ID NO: 79567 - DNA, 19 bp, Homo sapiens
gactacaggggtgtgccac

SEQ ID NO: 79568 - DNA, 20 bp, Homo sapiens
gaactacaggcatgtgccac

SEQ ID NO: 79569 - DNA, 19 bp, Homo sapiens
gactacaggcttgcgccac

SEQ ID NO: 79570 - DNA, 19 bp, Homo sapiens
gaaacagagtgaaactcca

SEQ ID NO: 79571 - DNA, 19 bp, Homo sapiens
gattacgggtgtgtgccac

SEQ ID NO: 79572 - DNA, 19 bp, Homo sapiens
gatcacaggcatgcgccac

SEQ ID NO: 79573 - DNA, 19 bp, Homo sapiens
gactacaggcctgtgccac

SEQ ID NO: 79574 - DNA, 20 bp, Homo sapiens
gaatatagtgtgccccccac

SEQ ID NO: 79575 - DNA, 19 bp, Homo sapiens
gatcacaggtacgcgtcac

SEQ ID NO: 79576 - DNA, 18 bp, Homo sapiens
gattacaggcatgtgcca

SEQ ID NO: 79577 - DNA, 20 bp, Homo sapiens
gaattatagggatgtgccac

SEQ ID NO: 79578 - DNA, 19 bp, Homo sapiens
gactacaggtgcgtgccac

SEQ ID NO: 79579 - DNA, 18 bp, Homo sapiens
gactacagttgtgtgcca

SEQ ID NO: 79580 - DNA, 19 bp, Homo sapiens
gaatgcaggtgtgtgccac

SEQ ID NO: 79581 - DNA, 20 bp, Homo sapiens
gaattacaggcacgtgccac

SEQ ID NO: 79582 - DNA, 19 bp, Homo sapiens
gattacagacatgcgccac

SEQ ID NO: 79583 - DNA, 19 bp, Homo sapiens
taggacacagaggtgccgc

SEQ ID NO: 79584 - DNA, 20 bp, Homo sapiens
gaattacagggatgtgccac

SEQ ID NO: 79585 - DNA, 19 bp, Homo sapiens
tagggacagagtaagctgc

SEQ ID NO: 79586 - DNA, 19 bp, Homo sapiens
gattacaggcgtgtgctac

SEQ ID NO: 79587 - DNA, 19 bp, Homo sapiens
gactacaggcgcgtgccgc

SEQ ID NO: 79588 - DNA, 19 bp, Homo sapiens
gaatgcaggtgcgtgccac

SEQ ID NO: 79589 - DNA, 19 bp, Homo sapiens
gactacaggcacgcgccac

SEQ ID NO: 79590 - DNA, 17 bp, Homo sapiens
tagatacagagtgtcca

SEQ ID NO: 79591 - DNA, 19 bp, Homo sapiens
gatgacaggtgtgtgccac

SEQ ID NO: 79592 - DNA, 19 bp, Homo sapiens
gactacaggggcccgccac

SEQ ID NO: 79593 - DNA, 19 bp, Homo sapiens
gattacaggcgtgtgtcac

SEQ ID NO: 79594 - DNA, 18 bp, Homo sapiens
gattacagagaccgccac

SEQ ID NO: 79595 - DNA, 20 bp, Homo sapiens
gaagacagagtgagactcca

SEQ ID NO: 79596 - DNA, 19 bp, Homo sapiens
aatgcagagtggtcgaggc

SEQ ID NO: 79597 - DNA, 18 bp, Homo sapiens
gaaacagagtgagcctgc

SEQ ID NO: 79598 - DNA, 64 bp, Newcastle disease virus
gttctggtagtctgtcagttcggagagttaagaaaaaactaccggttgtagatgaccaaaggac

SEQ ID NO: 79599 - DNA, 24 bp, Newcastle disease virus
tagtctgtcagttcggagagttaa

SEQ ID NO: 79600 - DNA, 20 bp, Homo sapiens
agtctgtccaggggagggtt

SEQ ID NO: 79601 - DNA, 21 bp, Homo sapiens
tagtttgtcagttatcattga

SEQ ID NO: 79602 - DNA, 15 bp, Homo sapiens
tctgtcagtgggtta

SEQ ID NO: 79603 - DNA, 17 bp, Homo sapiens
tagtctgcggtttggga

SEQ ID NO: 79604 - DNA, 22 bp, Homo sapiens
gtctgtggtttgaaaaagttaa

SEQ ID NO: 79605 - DNA, 19 bp, Homo sapiens
gtctgtcagtacacaggtt

SEQ ID NO: 79606 - DNA, 19 bp, Homo sapiens
gtctgtcatccttagagtt

SEQ ID NO: 79607 - DNA, 20 bp, Homo sapiens
gtgctggaaggtggagagtt

SEQ ID NO: 79608 - DNA, 22 bp, Homo sapiens
tagtctgccaaatgagagttaa

SEQ ID NO: 79609 - DNA, 18 bp, Homo sapiens
cagtttgtcagtttggag

SEQ ID NO: 79610 - DNA, 81 bp, Lumpy skin disease virus
gaaacttttactaattttgaataacacgatgagcatgtcatgcattcttcatcttgtacagttgtttttggttttcgtttc

SEQ ID NO: 79611 - DNA, 24 bp, Lumpy skin disease virus
tgtacagttgtttttggttttcgt

SEQ ID NO: 79612 - DNA, 19 bp, Homo sapiens
gtcagctgttggtttttgt

SEQ ID NO: 79613 - DNA, 17 bp, Homo sapiens
tgtcagttgttggtttt

SEQ ID NO: 79614 - DNA, 81 bp, Sheeppox virus
gaaacttttactaattttgaataacacgatgagcatatcatgcattcttcatcttgtacagttgtttttggttttcgtttc

SEQ ID NO: 79615 - DNA, 24 bp, Sheeppox virus
tgaataacacgatgagcatatcat

SEQ ID NO: 79616 - DNA, 18 bp, Homo sapiens
gagtaacacgatgggcac

SEQ ID NO: 79617 - DNA, 20 bp, Homo sapiens
tggacaacacggtgaaacat

SEQ ID NO: 79618 - DNA, 21 bp, Homo sapiens
taaatgacactttcatatcat

SEQ ID NO: 79619 - DNA, 21 bp, Homo sapiens
tgaatgacacgatattcacat

SEQ ID NO: 79620 - DNA, 87 bp, Chimpanzee cytomegalovirus
gctactacgacgactaagcccaagacgaacaacgtgcgcgtgcgtaccgtgcggcgacaggtgacgatagcgtgtcgacgtccatgc

SEQ ID NO: 79621 - DNA, 20 bp, Chimpanzee cytomegalovirus
tagcgtgtcgacgtccatgc

SEQ ID NO: 79622 - DNA, 20 bp, Homo sapiens
tagctgggccccgtccatgc

SEQ ID NO: 79623 - DNA, 18 bp, Homo sapiens
gcttcagagcgtccatgc

SEQ ID NO: 79624 - DNA, 17 bp, Homo sapiens
tagcgtgtgacagctgc

SEQ ID NO: 79625 - DNA, 18 bp, Homo sapiens
tatcagtaacgtccatgc

SEQ ID NO: 79626 - DNA, 19 bp, Homo sapiens
gcaagggtgacgtccatgc

SEQ ID NO: 79627 - DNA, 17 bp, Homo sapiens
tagcatgtaagccatgc

SEQ ID NO: 79628 - DNA, 19 bp, Homo sapiens
cagccctcagtgtccatgc

SEQ ID NO: 79629 - DNA, 15 bp, Homo sapiens
gcgtgcggcccacgc

SEQ ID NO: 79630 - DNA, 16 bp, Homo sapiens
gccatgatgtccatgc

SEQ ID NO: 79631 - DNA, 18 bp, Homo sapiens
cagcgtgtgagccccatg

SEQ ID NO: 79632 - DNA, 18 bp, Homo sapiens
aggtgtcagggtccatgc

SEQ ID NO: 79633 - DNA, 20 bp, Homo sapiens
aacaaatccggtgtccatgc

SEQ ID NO: 79634 - DNA, 18 bp, Homo sapiens
taactgggtacgtccatg

SEQ ID NO: 79635 - DNA, 19 bp, Homo sapiens
cagcgtgtgagggtctgtg

SEQ ID NO: 79636 - DNA, 15 bp, Homo sapiens
tagcatgtgcccatg

SEQ ID NO: 79637 - DNA, 17 bp, Homo sapiens
gcgtgcgttgtccatgc

SEQ ID NO: 79638 - DNA, 19 bp, Homo sapiens
tagatgtagccgtccatgc

SEQ ID NO: 79639 - DNA, 20 bp, Homo sapiens
agcgtgtctctcttccatgc

SEQ ID NO: 79640 - DNA, 20 bp, Homo sapiens
agtgtgttctgagcccatgc

SEQ ID NO: 79641 - DNA, 18 bp, Homo sapiens
taggtgtcgactggatgc

SEQ ID NO: 79642 - DNA, 71 bp, Paramecium bursaria Chlorella virus 1
ggccattcaagtctattttcccaagcactactaccacacccaacagcagtccttttagtgcatttgcagcc

SEQ ID NO: 79643 - DNA, 17 bp, Paramecium bursaria Chlorella virus 1
ttagtgcatttgcagcc

SEQ ID NO: 79644 - DNA, 19 bp, Homo sapiens
ttaatgcagaaacacagcc

SEQ ID NO: 79645 - DNA, 24 bp, Homo sapiens
ttaatgcaattaaatttgcagccg

SEQ ID NO: 79646 - DNA, 18 bp, Homo sapiens
ttaatgcatggacaggcc

SEQ ID NO: 79647 - DNA, 18 bp, Homo sapiens
tcagtacaactttgtagc

SEQ ID NO: 79648 - DNA, 19 bp, Homo sapiens
ttagtgcacaaatacagcc

SEQ ID NO: 79649 - DNA, 18 bp, Homo sapiens
ttagtacaaattccagcc

SEQ ID NO: 79650 - DNA, 61 bp, Rat cytomegalovirus
gtgggcgccctacgtcggactatgggacctctgacgcggtctcgctgcgtgatcgccccac

SEQ ID NO: 79651 - DNA, 20 bp, Rat cytomegalovirus
tcgctgcgtgatcgccccac

SEQ ID NO: 79652 - DNA, 15 bp, Homo sapiens
tcctgcggatcccca

SEQ ID NO: 79653 - DNA, 20 bp, Homo sapiens
tcgcttccgcaccgccccac

SEQ ID NO: 79654 - DNA, 15 bp, Homo sapiens
tcgctggacacccca

SEQ ID NO: 79655 - DNA, 18 bp, Homo sapiens
tctccccgtgtcgcccca

SEQ ID NO: 79656 - DNA, 20 bp, Homo sapiens
acctcaggtgatcgccccac

SEQ ID NO: 79657 - DNA, 15 bp, Homo sapiens
tcctggctcgcccca

SEQ ID NO: 79658 - DNA, 17 bp, Homo sapiens
ccgctgctacgccccac

SEQ ID NO: 79659 - DNA, 20 bp, Homo sapiens
tcactgcggctccggcccca

SEQ ID NO: 79660 - DNA, 20 bp, Homo sapiens
cgctgcgtctcctgccctac

SEQ ID NO: 79661 - DNA, 19 bp, Homo sapiens
ccgctgcgcccggccccac

SEQ ID NO: 79662 - DNA, 18 bp, Homo sapiens
ccgctgcgccctcctcac

SEQ ID NO: 79663 - DNA, 17 bp, Homo sapiens
ccgctgcgtggcggcac

SEQ ID NO: 79664 - DNA, 19 bp, Homo sapiens
tcactgcagaaagctccac

SEQ ID NO: 79665 - DNA, 15 bp, Homo sapiens
gctgccgcgccccac

SEQ ID NO: 79666 - DNA, 18 bp, Homo sapiens
ccgcagctatcgcctcac

SEQ ID NO: 79667 - DNA, 20 bp, Homo sapiens
ccgctgcgcatgcgcttcac

SEQ ID NO: 79668 - DNA, 18 bp, Homo sapiens
ccgctgcgccccggtccc

SEQ ID NO: 79669 - DNA, 18 bp, Homo sapiens
cgctgcgcgccgcgcccc

SEQ ID NO: 79670 - DNA, 23 bp, Homo sapiens
tcgctgcgtcatgaccctcccac

SEQ ID NO: 79671 - DNA, 15 bp, Homo sapiens
tcgctgcatgaccca

SEQ ID NO: 79672 - DNA, 20 bp, Homo sapiens
tcactgcaacctccgcctca

SEQ ID NO: 79673 - DNA, 17 bp, Homo sapiens
ccgccgccaatcgcccc

SEQ ID NO: 79674 - DNA, 19 bp, Homo sapiens
tcctgcgtgaggcttccac

SEQ ID NO: 79675 - DNA, 15 bp, Homo sapiens
ccgctgcgccacccc

SEQ ID NO: 79676 - DNA, 15 bp, Homo sapiens
ccgctgcgccgcccc

SEQ ID NO: 79677 - DNA, 20 bp, Homo sapiens
tcgccgcacgcacgtcccac

SEQ ID NO: 79678 - DNA, 17 bp, Homo sapiens
tcctgcacgagccccac

SEQ ID NO: 79679 - DNA, 17 bp, Homo sapiens
gctgatgtccgccccac

SEQ ID NO: 79680 - DNA, 19 bp, Homo sapiens
tcactgcatcctgccccac

SEQ ID NO: 79681 - DNA, 17 bp, Homo sapiens
gctgcgcgcggccccac

SEQ ID NO: 79682 - DNA, 17 bp, Homo sapiens
tcgccgcgttgccctac

SEQ ID NO: 79683 - DNA, 16 bp, Homo sapiens
ccgctgcgtgcgcccc

SEQ ID NO: 79684 - DNA, 18 bp, Homo sapiens
tctcttgtctcgccccac

SEQ ID NO: 79685 - DNA, 16 bp, Homo sapiens
ccgctgcgcagcccca

SEQ ID NO: 79686 - DNA, 18 bp, Homo sapiens
cgcccagcatcgccccac

SEQ ID NO: 79687 - DNA, 18 bp, Homo sapiens
tcgctgcagacctcggcc

SEQ ID NO: 79688 - DNA, 18 bp, Homo sapiens
tcgtggtgtgccagccac

SEQ ID NO: 79689 - DNA, 21 bp, Homo sapiens
tcactgcaacctctgcctcac

SEQ ID NO: 79690 - DNA, 16 bp, Homo sapiens
ccgctgcgcccgcccc

SEQ ID NO: 79691 - DNA, 18 bp, Homo sapiens
ccgctgcgtgtccagccc

SEQ ID NO: 79692 - DNA, 18 bp, Homo sapiens
tcgccgcgtgcggctccc

SEQ ID NO: 79693 - DNA, 18 bp, Homo sapiens
tcgctacgcctctcccac

SEQ ID NO: 79694 - DNA, 22 bp, Homo sapiens
tcgctgcgggagaagtccctac

SEQ ID NO: 79695 - DNA, 19 bp, Homo sapiens
tccttctcaatcgcctcac

SEQ ID NO: 79696 - DNA, 18 bp, Homo sapiens
tcacaagcatcgccccac

SEQ ID NO: 79697 - DNA, 17 bp, Homo sapiens
ccgctgtcccgccccac

SEQ ID NO: 79698 - DNA, 20 bp, Homo sapiens
tcacatgactgattgctcca

SEQ ID NO: 79699 - DNA, 17 bp, Homo sapiens
tcctgggtccgccccac

SEQ ID NO: 79700 - DNA, 16 bp, Homo sapiens
gctgcgcagcctccac

SEQ ID NO: 79701 - DNA, 18 bp, Homo sapiens
tcactgcatcttcgctcc

SEQ ID NO: 79702 - DNA, 17 bp, Homo sapiens
tcgctgcaatcgcccca

SEQ ID NO: 79703 - DNA, 20 bp, Homo sapiens
tcactgcaacctctgcctca

SEQ ID NO: 79704 - DNA, 17 bp, Homo sapiens
ccgaccgggatcgcccc

SEQ ID NO: 79705 - DNA, 20 bp, Homo sapiens
ccgctgcagcatcgccccac

SEQ ID NO: 79706 - DNA, 21 bp, Homo sapiens
gctgcgtgattccagctccca

SEQ ID NO: 79707 - DNA, 18 bp, Homo sapiens
tcactgcacctgcttcac

SEQ ID NO: 79708 - DNA, 17 bp, Homo sapiens
cgctgcgccgccttcac

SEQ ID NO: 79709 - DNA, 17 bp, Homo sapiens
ccgacggtgatcgcccc

SEQ ID NO: 79710 - DNA, 21 bp, Homo sapiens
cgctgcgttccccagccccac

SEQ ID NO: 79711 - DNA, 16 bp, Homo sapiens
gctgtgctcaccccac

SEQ ID NO: 79712 - DNA, 88 bp, Ictalurid herpesvirus 1
tactgtaggaaaaaaaaggatggttgtcgatgtattggttcagacggctttccgtctattcaatttcatgacgagtttctacgaggta

SEQ ID NO: 79713 - DNA, 20 bp, Ictalurid herpesvirus 1
tgacgagtttctacgaggta

SEQ ID NO: 79714 - DNA, 17 bp, Homo sapiens
tgacgagttcttgaagt

SEQ ID NO: 79715 - DNA, 18 bp, Homo sapiens
cgatgaggcccacgaggt

SEQ ID NO: 79716 - DNA, 21 bp, Homo sapiens
tgaagagtttcccccacaggt

SEQ ID NO: 79717 - DNA, 17 bp, Homo sapiens
gacggctgctacgaggt

SEQ ID NO: 79718 - DNA, 15 bp, Homo sapiens
gacgagttctcaggt

SEQ ID NO: 79719 - DNA, 21 bp, Homo sapiens
tgatgagttcctgatgaggta

SEQ ID NO: 79720 - DNA, 15 bp, Homo sapiens
tgagagttcccaggt

SEQ ID NO: 79721 - DNA, 18 bp, Homo sapiens
tgatgagcttctgaaata

SEQ ID NO: 79722 - DNA, 19 bp, Homo sapiens
tgaagagtttcccactgta

SEQ ID NO: 79723 - DNA, 18 bp, Homo sapiens
tgacaagttggaaaggta

SEQ ID NO: 79724 - DNA, 65 bp, Tobacco necrosis virus D
ataattgttcagcagaatgatcctttaccccttttgggggtttggatcatagtcatcataattat

SEQ ID NO: 79725 - DNA, 24 bp, Tobacco necrosis virus D
ttggatcatagtcatcataattat

SEQ ID NO: 79726 - DNA, 19 bp, Homo sapiens
ttggactgtatcataatta

SEQ ID NO: 79727 - DNA, 22 bp, Homo sapiens
gatcatgagttttcataattat

SEQ ID NO: 79728 - DNA, 100 bp, Sulfolobus virus SIRV-2
tttcacctaattatttaattttatcgataatttttctccttttccaaatattatttctaaaagttgaaaatatgaatttgatatactaagtgttatgaag

SEQ ID NO: 79729 - DNA, 24 bp, Sulfolobus virus SIRV-2
tttatcgataatttttctcctttt

SEQ ID NO: 79730 - DNA, 17 bp, Homo sapiens
gacaattttctcctttt

SEQ ID NO: 79731 - DNA, 21 bp, Homo sapiens
tttattataatttctcctttt

SEQ ID NO: 79732 - DNA, 20 bp, Homo sapiens
tcaccaatttttttcctttt

SEQ ID NO: 79733 - DNA, 18 bp, Homo sapiens
tcttaattttctcctttt

SEQ ID NO: 79734 - DNA, 23 bp, Homo sapiens
tctgtctttccttttctcctttt

SEQ ID NO: 79735 - DNA, 18 bp, Homo sapiens
gattttctttctcctttt

SEQ ID NO: 79736 - DNA, 17 bp, Homo sapiens
tttatcataatctttct

SEQ ID NO: 79737 - DNA, 25 bp, Homo sapiens
ttcatctttctctttttcttctttt

SEQ ID NO: 79738 - DNA, 66 bp, Pea enation mosaic virus-2
gggaagccggggagtcaccaacccaccctgaatcgacagggcaaaaagggaagccgggcaccgccc

SEQ ID NO: 79739 - DNA, 24 bp, Pea enation mosaic virus-2
agtcaccaacccaccctgaatcga

SEQ ID NO: 79740 - DNA, 19 bp, Homo sapiens
agtcaccagcaccatctga

SEQ ID NO: 79741 - DNA, 22 bp, Homo sapiens
agtaccaacccatccaccccga

SEQ ID NO: 79742 - DNA, 21 bp, Homo sapiens
gtcaccaccctagaggaatcg

SEQ ID NO: 79743 - DNA, 20 bp, Homo sapiens
agtcaccatccaccagctga

SEQ ID NO: 79744 - DNA, 21 bp, Homo sapiens
agataccagcccacccctcga

SEQ ID NO: 79745 - DNA, 18 bp, Homo sapiens
agtccccagcccaccctg

SEQ ID NO: 79746 - DNA, 16 bp, Homo sapiens
agtcaccaacctcctg

SEQ ID NO: 79747 - DNA, 21 bp, Homo sapiens
agtaacctgggtcctgaatcg

SEQ ID NO: 79748 - DNA, 17 bp, Homo sapiens
agtcaccaggccacctg

SEQ ID NO: 79749 - DNA, 24 bp, Homo sapiens
gtcaccaatgtgcctccgctctga

SEQ ID NO: 79750 - DNA, 19 bp, Homo sapiens
agtcaccaacctgctctca

SEQ ID NO: 79751 - DNA, 18 bp, Homo sapiens
agtcaccagcaccgtctg

SEQ ID NO: 79752 - DNA, 20 bp, Homo sapiens
agtcaccaaccaacttctca

SEQ ID NO: 79753 - DNA, 21 bp, Homo sapiens
agacaccagctcaccccatca

SEQ ID NO: 79754 - DNA, 18 bp, Homo sapiens
agtcaccagtccacgctg

SEQ ID NO: 79755 - DNA, 20 bp, Homo sapiens
agtcaccaatccattgctga

SEQ ID NO: 79756 - DNA, 19 bp, Homo sapiens
agtaccaacccatcttctg

SEQ ID NO: 79757 - DNA, 21 bp, Homo sapiens
agtcaccagccaccaccctga

SEQ ID NO: 79758 - DNA, 18 bp, Homo sapiens
agtcccaacccacttaga

SEQ ID NO: 79759 - DNA, 20 bp, Homo sapiens
agccaccagccccaaggtcg

SEQ ID NO: 79760 - DNA, 23 bp, Homo sapiens
agtttccaacccagagcatatcg

SEQ ID NO: 79761 - DNA, 19 bp, Homo sapiens
agccaccagggccttgaat

SEQ ID NO: 79762 - DNA, 20 bp, Homo sapiens
agtcaccatcctgctcctcg

SEQ ID NO: 79763 - DNA, 24 bp, Homo sapiens
agtcactgggccaccccacccaga

SEQ ID NO: 79764 - DNA, 20 bp, Homo sapiens
agtcacccgcccacccctga

SEQ ID NO: 79765 - DNA, 19 bp, Homo sapiens
agtcaccaactacacatcg

SEQ ID NO: 79766 - DNA, 19 bp, Homo sapiens
gtcaccaccccatttcctg

SEQ ID NO: 79767 - DNA, 17 bp, Homo sapiens
agtcatcagccaccctg

SEQ ID NO: 79768 - DNA, 17 bp, Homo sapiens
agccaccagcccatctg

SEQ ID NO: 79769 - DNA, 19 bp, Homo sapiens
agtcaccaacttcacctct

SEQ ID NO: 79770 - DNA, 22 bp, Homo sapiens
agtctcctcaaccctgaattga

SEQ ID NO: 79771 - DNA, 122 bp, Periplaneta fuliginosa densovirus
ttggccatagcttcgctataccccaccacaaccaccaccaccacgaccggacacatggcctttggccgtgtccatggtgtggtggtggtggttgtggtggggtatagcgaagctatggccaa

SEQ ID NO: 79772 - DNA, 24 bp, Periplaneta fuliginosa densovirus
tccatggtgtggtggtggtggttg

SEQ ID NO: 79773 - DNA, 19 bp, Homo sapiens
cctatggtgtggttttggt

SEQ ID NO: 79774 - DNA, 20 bp, Homo sapiens
tgtcattgtggtggtggttg

SEQ ID NO: 79775 - DNA, 19 bp, Homo sapiens
cctgtggtgtggctatggt

SEQ ID NO: 79776 - DNA, 18 bp, Homo sapiens
tgttgttggtggtggttg

SEQ ID NO: 79777 - DNA, 20 bp, Homo sapiens
tccgtgggtggtggtgcatg

SEQ ID NO: 79778 - DNA, 24 bp, Homo sapiens
tggttttggtggtggtggtggttg

SEQ ID NO: 79779 - DNA, 21 bp, Homo sapiens
tggtggtggtggtggtggttg

SEQ ID NO: 79780 - DNA, 20 bp, Homo sapiens
tcctggtgtggtggtgcatg

SEQ ID NO: 79781 - DNA, 18 bp, Homo sapiens
tggcgtcgcaggtggttg

SEQ ID NO: 79782 - DNA, 19 bp, Homo sapiens
tgttggatggtggtggttg

SEQ ID NO: 79783 - DNA, 19 bp, Homo sapiens
tggtgttgatgggtggttg

SEQ ID NO: 79784 - DNA, 21 bp, Homo sapiens
tccagggtgtggtggtgccag

SEQ ID NO: 79785 - DNA, 18 bp, Homo sapiens
gtcaggtggtggtggttg

SEQ ID NO: 79786 - DNA, 20 bp, Homo sapiens
gtgtggtgtagtggtggttg

SEQ ID NO: 79787 - DNA, 18 bp, Homo sapiens
gctgtcgtggtggtggtt

SEQ ID NO: 79788 - DNA, 18 bp, Homo sapiens
gggtggtggtggtggttg

SEQ ID NO: 79789 - DNA, 17 bp, Homo sapiens
tctgtggtgtggggtgg

SEQ ID NO: 79790 - DNA, 20 bp, Homo sapiens
tctgtggtgggtggtggtgg

SEQ ID NO: 79791 - DNA, 20 bp, Homo sapiens
cggggcctcggtggtggttg

SEQ ID NO: 79792 - DNA, 19 bp, Homo sapiens
atgttgtggttagtggttg

SEQ ID NO: 79793 - DNA, 17 bp, Homo sapiens
catggtggtggtggtgg

SEQ ID NO: 79794 - DNA, 62 bp, Paramecium bursaria Chlorella virus 1
tttgtatttacatttccaagagacaatatacctcctacggacaatgtactcatcaatacaga

SEQ ID NO: 79795 - DNA, 23 bp, Paramecium bursaria Chlorella virus 1
gacaatgtactcatcaatacaga

SEQ ID NO: 79796 - DNA, 22 bp, Homo sapiens
gaaatgagtccatcaatacaga

SEQ ID NO: 79797 - DNA, 19 bp, Homo sapiens
acagtggcaatcaatacag

SEQ ID NO: 79798 - DNA, 23 bp, Homo sapiens
aacaacagtcttgtcaatacaga

SEQ ID NO: 79799 - DNA, 20 bp, Homo sapiens
gacaatgtctcaggcccaga

SEQ ID NO: 79800 - DNA, 20 bp, Homo sapiens
gacaggttatatcaatacag

SEQ ID NO: 79801 - DNA, 20 bp, Homo sapiens
caacagcccatcaatgcaga

SEQ ID NO: 79802 - DNA, 20 bp, Homo sapiens
gcaatgtattaaaatacaga

SEQ ID NO: 79803 - DNA, 21 bp, Homo sapiens
gaaaatgtactcagaagcaga

SEQ ID NO: 79804 - DNA, 23 bp, Homo sapiens
gacagactttttatcaatacaga

SEQ ID NO: 79805 - DNA, 19 bp, Homo sapiens
gcaatgtacttcttacaga

SEQ ID NO: 79806 - DNA, 24 bp, Homo sapiens
gatgatgcacccattctgatgcag

SEQ ID NO: 79807 - DNA, 19 bp, Homo sapiens
cactcttcattaatacaga

SEQ ID NO: 79808 - DNA, 17 bp, Homo sapiens
gacaatatatccaacag

SEQ ID NO: 79809 - DNA, 20 bp, Homo sapiens
gacaatgtacaaaatacaga

SEQ ID NO: 79810 - DNA, 18 bp, Homo sapiens
gacaatgtactattacaa

SEQ ID NO: 79811 - DNA, 19 bp, Homo sapiens
gacaatgtatgcattatac

SEQ ID NO: 79812 - DNA, 69 bp, Human herpesvirus 5
gagcggacacggttatcgttcctggcggatataagtatataaacgcgagttagcctttcccgtccgttt

SEQ ID NO: 79813 - DNA, 24 bp, Human herpesvirus 5
taaacgcgagttagcctttcccgt

SEQ ID NO: 79814 - DNA, 17 bp, Homo sapiens
acagcgagtttttcccg

SEQ ID NO: 79815 - DNA, 63 bp, Human herpesvirus 5
ggcgtccgcgtgtctaaaccgcgtgctcgctgacgcgggtttgcttcctatatagtggacgtc

SEQ ID NO: 79816 - DNA, 24 bp, Human herpesvirus 5
gtttgcttcctatatagtggacgt

SEQ ID NO: 79817 - DNA, 16 bp, Homo sapiens
gtttgctttctattgg

SEQ ID NO: 79818 - DNA, 19 bp, Homo sapiens
atttgcttcttgtacagcg

SEQ ID NO: 79819 - DNA, 19 bp, Homo sapiens
gtttgcttttttataatgg

SEQ ID NO: 79820 - DNA, 18 bp, Homo sapiens
gtctgcttcagggtggag

SEQ ID NO: 79821 - DNA, 19 bp, Homo sapiens
gtttgcttctgatgtggca

SEQ ID NO: 79822 - DNA, 103 bp, Gallid herpesvirus 2
gaaacaagcaatatattcttaagttataggtacgtcaaaccacatcaaggtatatcccctctctttataaactgtacaatcatactcatatattgtaggtatc

SEQ ID NO: 79823 - DNA, 24 bp, Gallid herpesvirus 2
tcttaagttataggtacgtcaaac

SEQ ID NO: 79824 - DNA, 21 bp, Homo sapiens
tcttaagttagagtacacatc

SEQ ID NO: 79825 - DNA, 18 bp, Homo sapiens
tcttaagttacagtagac

SEQ ID NO: 79826 - DNA, 18 bp, Homo sapiens
ccttgggttataggtccg

SEQ ID NO: 79827 - DNA, 19 bp, Homo sapiens
ttaagttatatgctgtcaa

SEQ ID NO: 79828 - DNA, 20 bp, Homo sapiens
ttaagttataatgcatcaaa

SEQ ID NO: 79829 - DNA, 23 bp, Homo sapiens
tcttgaggtcaaaaacgtcaaac

SEQ ID NO: 79830 - DNA, 25 bp, Homo sapiens
tcctaagttatataatttgtcaaac

SEQ ID NO: 79831 - DNA, 131 bp, Amsacta moorei entomopoxvirus
tttatatcattttcattttgtttaataacattatctatgatatgtataataaataatttataattgtcgatataatttatatattcagtattatcttcaacattaatattaaagaaaatcaaattaagaaa

SEQ ID NO: 79832 - DNA, 24 bp, Amsacta moorei entomopoxvirus
tgtataataaataatttataattg

SEQ ID NO: 79833 - DNA, 24 bp, Homo sapiens
tgtataataaaaaactaaaaattg

SEQ ID NO: 79834 - DNA, 23 bp, Homo sapiens
tgtataataaataaacattattg

SEQ ID NO: 79835 - DNA, 23 bp, Homo sapiens
tgtaaattgacaatttataattg

SEQ ID NO: 79836 - DNA, 80 bp, Chimpanzee cytomegalovirus
atagtaaaacctcccgaatctcagtctctcgaagcgtggttctgccagcgtccatgcctcgggagctcgaagggtgctat

SEQ ID NO: 79837 - DNA, 24 bp, Chimpanzee cytomegalovirus
tgcctcgggagctcgaagggtgct

SEQ ID NO: 79838 - DNA, 20 bp, Homo sapiens
tgcctcgggagctccggggt

SEQ ID NO: 79839 - DNA, 18 bp, Homo sapiens
gccttgggggcttgagga

SEQ ID NO: 79840 - DNA, 22 bp, Homo sapiens
tgtcctctgcttggagggtgct

SEQ ID NO: 79841 - DNA, 16 bp, Homo sapiens
tgcctgctggagggtg

SEQ ID NO: 79842 - DNA, 21 bp, Homo sapiens
cctttgggacccaagggtgct

SEQ ID NO: 79843 - DNA, 19 bp, Homo sapiens
tgcttcaggagctgggtgc

SEQ ID NO: 79844 - DNA, 19 bp, Homo sapiens
tgctttggaagcttgaggc

SEQ ID NO: 79845 - DNA, 16 bp, Homo sapiens
cttgggaaaagggtgc

SEQ ID NO: 79846 - DNA, 21 bp, Homo sapiens
tgcttcagcaggaagggtgct

SEQ ID NO: 79847 - DNA, 23 bp, Homo sapiens
gctggcgtagagcttgaggggtg

SEQ ID NO: 79848 - DNA, 21 bp, Homo sapiens
tgcccgggagctccccctgct

SEQ ID NO: 79849 - DNA, 21 bp, Homo sapiens
tgcccgtccccgaagggtgct

SEQ ID NO: 79850 - DNA, 21 bp, Homo sapiens
tgccatggggttcagggtgct

SEQ ID NO: 79851 - DNA, 18 bp, Homo sapiens
tgccttgggagcccatgc

SEQ ID NO: 79852 - DNA, 80 bp, Equine herpesvirus 2
ctgttgacaggtagagatcccgggaggtaaaggtgcataggcacacctgcgcctgactctccttttctacctgaccgcag

SEQ ID NO: 79853 - DNA, 24 bp, Equine herpesvirus 2
gacaggtagagatcccgggaggta

SEQ ID NO: 79854 - DNA, 20 bp, Homo sapiens
ggagagtgatcccggggggt

SEQ ID NO: 79855 - DNA, 24 bp, Homo sapiens
gataggagagaagtgagggaggta

SEQ ID NO: 79856 - DNA, 18 bp, Homo sapiens
gagaggtagctgggaggt

SEQ ID NO: 79857 - DNA, 18 bp, Homo sapiens
gacagcctctcgggaggt

SEQ ID NO: 79858 - DNA, 19 bp, Homo sapiens
gacaggtagggacgagggt

SEQ ID NO: 79859 - DNA, 18 bp, Homo sapiens
aggttgagatggaaggta

SEQ ID NO: 79860 - DNA, 21 bp, Homo sapiens
aacagaaacatttcggggggt

SEQ ID NO: 79861 - DNA, 15 bp, Homo sapiens
ggtagaaagggaggt

SEQ ID NO: 79862 - DNA, 25 bp, Homo sapiens
gatgggtggagatggaattgaggta

SEQ ID NO: 79863 - DNA, 20 bp, Homo sapiens
cagggggagtggaggaggta

SEQ ID NO: 79864 - DNA, 19 bp, Homo sapiens
gacgggaggagacagaggt

SEQ ID NO: 79865 - DNA, 19 bp, Homo sapiens
caggtagatgtcagcaggt

SEQ ID NO: 79866 - DNA, 24 bp, Homo sapiens
gacaggggtctgtcctgggaggta

SEQ ID NO: 79867 - DNA, 17 bp, Homo sapiens
caggtggaggggaggca

SEQ ID NO: 79868 - DNA, 15 bp, Homo sapiens
ggcaggagggaggca

SEQ ID NO: 79869 - DNA, 19 bp, Homo sapiens
gcaggtggagcgcgggggt

SEQ ID NO: 79870 - DNA, 22 bp, Homo sapiens
caggaagaccgggtgggaggta

SEQ ID NO: 79871 - DNA, 23 bp, Homo sapiens
caggtagtctgacctgggaggta

SEQ ID NO: 79872 - DNA, 19 bp, Homo sapiens
gggggaggtccaggaggta

SEQ ID NO: 79873 - DNA, 22 bp, Homo sapiens
gacagggagaggagagggaggt

SEQ ID NO: 79874 - DNA, 19 bp, Homo sapiens
gataggctagagaggaggt

SEQ ID NO: 79875 - DNA, 17 bp, Homo sapiens
aggtagagaatggaggt

SEQ ID NO: 79876 - DNA, 22 bp, Homo sapiens
ggaggtaggggatgaaggaggt

SEQ ID NO: 79877 - DNA, 15 bp, Homo sapiens
aggcaggagggaggt

SEQ ID NO: 79878 - DNA, 18 bp, Homo sapiens
aacaggtagggatctggg

SEQ ID NO: 79879 - DNA, 77 bp, Sulfolobus virus SIRV-2
ttaaatttttatcactctatattttcaacctttagaaatagtatctgaaaaatgaaaaaaattaaagatagaattaa

SEQ ID NO: 79880 - DNA, 24 bp, Sulfolobus virus SIRV-2
tgaaaaatgaaaaaaattaaagat

SEQ ID NO: 79881 - DNA, 25 bp, Homo sapiens
tgaaaaatgaaataaaacctcagat

SEQ ID NO: 79882 - DNA, 21 bp, Homo sapiens
gagaaatgaaaaaaaaaagat

SEQ ID NO: 79883 - DNA, 25 bp, Homo sapiens
tgaaaagtgaaataaaccaacagat

SEQ ID NO: 79884 - DNA, 24 bp, Homo sapiens
tgaaaaatcaagaaattcaaagat

SEQ ID NO: 79885 - DNA, 24 bp, Homo sapiens
aaaaattaccaaaaaattaaagat

SEQ ID NO: 79886 - DNA, 21 bp, Homo sapiens
gaaaaatgaaaatgaaaagat

SEQ ID NO: 79887 - DNA, 20 bp, Homo sapiens
tgacaaatgaaaaaaattaa

SEQ ID NO: 79888 - DNA, 23 bp, Homo sapiens
gaaaaatgaagaaatttcaagat

SEQ ID NO: 79889 - DNA, 22 bp, Homo sapiens
gaaaaatgaaaaattgtaagat

SEQ ID NO: 79890 - DNA, 19 bp, Homo sapiens
taaaaaatgaaaaaaatta

SEQ ID NO: 79891 - DNA, 22 bp, Homo sapiens
tgaaaaaagaaaaatgctaaag

SEQ ID NO: 79892 - DNA, 18 bp, Homo sapiens
aaaatgaaaaaaatcaaa

SEQ ID NO: 79893 - DNA, 24 bp, Homo sapiens
taaaaaatggaaaaaatttcagat

SEQ ID NO: 79894 - DNA, 23 bp, Homo sapiens
tgaaaaataaaaaaattaatgat

SEQ ID NO: 79895 - DNA, 25 bp, Homo sapiens
tgaaaaatgaatgaaaacgaaagat

SEQ ID NO: 79896 - DNA, 85 bp, Sulfolobus virus SIRV-2
gataatttttctcactttccaaatattaattctaatttttaatgatttcttgaaattagtattatggaaagaagttttgattatc

SEQ ID NO: 79897 - DNA, 24 bp, Sulfolobus virus SIRV-2
ttgaaattagtattatggaaagaa

SEQ ID NO: 79898 - DNA, 20 bp, Homo sapiens
tgagattataatatggaaag

SEQ ID NO: 79899 - DNA, 22 bp, Homo sapiens
ctgaaatcagatatggagagaa

SEQ ID NO: 79900 - DNA, 20 bp, Homo sapiens
ttgaaaaatttatggaagga

SEQ ID NO: 79901 - DNA, 19 bp, Homo sapiens
gaaattagtcatggaagga

SEQ ID NO: 79902 - DNA, 22 bp, Homo sapiens
ttgaattagtatttgtacagaa

SEQ ID NO: 79903 - DNA, 19 bp, Homo sapiens
ttagattgttatggaaaga

SEQ ID NO: 79904 - DNA, 20 bp, Homo sapiens
ttgaaactagcctaggagag

SEQ ID NO: 79905 - DNA, 20 bp, Homo sapiens
ttaaaattagtaccaaggaa

SEQ ID NO: 79906 - DNA, 24 bp, Homo sapiens
tcgaaattagtattcatagtaaga

SEQ ID NO: 79907 - DNA, 18 bp, Homo sapiens
gaaattagtattctagaa

SEQ ID NO: 79908 - DNA, 21 bp, Homo sapiens
ttcaaattagtatccagagga

SEQ ID NO: 79909 - DNA, 20 bp, Homo sapiens
aaattagtacatgtaaagaa

SEQ ID NO: 79910 - DNA, 22 bp, Homo sapiens
ttgacattagtatctgtaaaga

SEQ ID NO: 79911 - DNA, 21 bp, Homo sapiens
ttgagatcagtgtatgaaaaa

SEQ ID NO: 79912 - DNA, 24 bp, Homo sapiens
ttgaaactggtacacgatggggag

SEQ ID NO: 79913 - DNA, 21 bp, Homo sapiens
ttgaaattaggatctggagag

SEQ ID NO: 79914 - DNA, 28 bp, Homo sapiens
ttgaaattggtatcggcaatttggaaag

SEQ ID NO: 79915 - DNA, 18 bp, Homo sapiens
ttaatttgtatggaaaga

SEQ ID NO: 79916 - DNA, 108 bp, Pepper ringspot virus
gaccagtttaaaacttgttttatttttactttatgtattgtcttgctttcgtttccttcaaagtgacgtcaacatactttcttgtagtttggtttttgagagctggtt

SEQ ID NO: 79917 - DNA, 24 bp, Pepper ringspot virus
tttatgtattgtcttgctttcgtt

SEQ ID NO: 79918 - DNA, 22 bp, Homo sapiens
ttcatgtatgtatgttttcgtt

SEQ ID NO: 79919 - DNA, 17 bp, Homo sapiens
tttatggattgtcttct

SEQ ID NO: 79920 - DNA, 82 bp, Human papillomavirus type 19
gatacgggcgcggttagaagttactcattcggtgcttgttgttgccaacaatcagcgttatgaacttgtttctgcctgtatc

SEQ ID NO: 79921 - DNA, 24 bp, Human papillomavirus type 19
gaagttactcattcggtgcttgtt

SEQ ID NO: 79922 - DNA, 23 bp, Homo sapiens
gaagttgcttatatacacctgtt

SEQ ID NO: 79923 - DNA, 19 bp, Homo sapiens
gaggttgctcattctggca

SEQ ID NO: 79924 - DNA, 22 bp, Homo sapiens
gaagttgctcattcatgttgtt

SEQ ID NO: 79925 - DNA, 20 bp, Homo sapiens
agttattcatctttcttgtt

SEQ ID NO: 79926 - DNA, 22 bp, Homo sapiens
ggattactgtaccgtgcttgtt

SEQ ID NO: 79927 - DNA, 21 bp, Homo sapiens
gaagttgttctaatgcttgtt

SEQ ID NO: 79928 - DNA, 61 bp, Human papillomavirus type 19
gtattatatatatatatatatatatatatatatatatatatatatatatatatatatatac

SEQ ID NO: 79929 - DNA, 24 bp, Human papillomavirus type 19
tatatatatatatatatatatata

SEQ ID NO: 79930 - DNA, 25 bp, Homo sapiens
tatataatatatattcatatatata

SEQ ID NO: 79931 - DNA, 25 bp, Homo sapiens
tatatataatatatattcatatata

SEQ ID NO: 79932 - DNA, 22 bp, Homo sapiens
tatatatatatatttatatata

SEQ ID NO: 79933 - DNA, 23 bp, Homo sapiens
tacatatatatacacatatgtat

SEQ ID NO: 79934 - DNA, 22 bp, Homo sapiens
tatatatatcatattatatata

SEQ ID NO: 79935 - DNA, 20 bp, Homo sapiens
catatatatatataaatata

SEQ ID NO: 79936 - DNA, 70 bp, Human papillomavirus type 25
gtgttatacatatatatatatatatatatatatatatatatatatatattatatatatacacgtagacac

SEQ ID NO: 79937 - DNA, 24 bp, Human papillomavirus type 25
tattatatatatacacgtagacac

SEQ ID NO: 79938 - DNA, 19 bp, Homo sapiens
attatatatatacataaac

SEQ ID NO: 79939 - DNA, 19 bp, Homo sapiens
cattatatatatacagata

SEQ ID NO: 79940 - DNA, 19 bp, Homo sapiens
attatatattaagtagaca

SEQ ID NO: 79941 - DNA, 17 bp, Homo sapiens
tatatatacacaaacac

SEQ ID NO: 79942 - DNA, 18 bp, Homo sapiens
tactatatatatatacat

SEQ ID NO: 79943 - DNA, 20 bp, Homo sapiens
tattatataaatacacaaag

SEQ ID NO: 79944 - DNA, 18 bp, Homo sapiens
attatatatatacagtaa

SEQ ID NO: 79945 - DNA, 20 bp, Homo sapiens
tattatacatatactgagta

SEQ ID NO: 79946 - DNA, 19 bp, Homo sapiens
tatatatatatgtatagac

SEQ ID NO: 79947 - DNA, 20 bp, Homo sapiens
tattatatatatacacagag

SEQ ID NO: 79948 - DNA, 20 bp, Homo sapiens
tatatatatatacgtcaaac

SEQ ID NO: 79949 - DNA, 19 bp, Homo sapiens
tatatatatactgtaacac

SEQ ID NO: 79950 - DNA, 20 bp, Homo sapiens
tataagtatacatgtagaca

SEQ ID NO: 79951 - DNA, 21 bp, Homo sapiens
tattacatatattacgataga

SEQ ID NO: 79952 - DNA, 22 bp, Homo sapiens
tattatactcatatgtagacac

SEQ ID NO: 79953 - DNA, 21 bp, Homo sapiens
cattgtatatatacaaaacac

SEQ ID NO: 79954 - DNA, 18 bp, Homo sapiens
tattatatatgtatacac

SEQ ID NO: 79955 - DNA, 23 bp, Homo sapiens
tatatatataattcagtaggcac

SEQ ID NO: 79956 - DNA, 21 bp, Homo sapiens
tatatatatatatttaaacac

SEQ ID NO: 79957 - DNA, 19 bp, Homo sapiens
tatatatgcacatctccac

SEQ ID NO: 79958 - DNA, 17 bp, Homo sapiens
tattatatataacacat

SEQ ID NO: 79959 - DNA, 21 bp, Homo sapiens
tattatatataatacataaca

SEQ ID NO: 79960 - DNA, 17 bp, Homo sapiens
ctatatatatatgcaga

SEQ ID NO: 79961 - DNA, 20 bp, Homo sapiens
tatatatatatacataatac

SEQ ID NO: 79962 - DNA, 19 bp, Homo sapiens
tattatatacatatcagta

SEQ ID NO: 79963 - DNA, 67 bp, Human papillomavirus type 20
gtgattaatatatatatatatatatatatatatatatatatatatatatatatatatatagatacat

SEQ ID NO: 79964 - DNA, 24 bp, Human papillomavirus type 20
taatatatatatatatatatatat

SEQ ID NO: 79965 - DNA, 18 bp, Homo sapiens
atatacatatatatatat

SEQ ID NO: 79966 - DNA, 23 bp, Homo sapiens
atatttatatatatatatatata

SEQ ID NO: 79967 - DNA, 21 bp, Homo sapiens
tatatatatatatatatataa

SEQ ID NO: 79968 - DNA, 20 bp, Homo sapiens
atatatatatatatatctac

SEQ ID NO: 79969 - DNA, 27 bp, Homo sapiens
atatatatataactgtatatatatata

SEQ ID NO: 79970 - DNA, 28 bp, Homo sapiens
taatatatatatatataactgtatatat

SEQ ID NO: 79971 - DNA, 24 bp, Homo sapiens
atatggatatatatatatatatat

SEQ ID NO: 79972 - DNA, 27 bp, Homo sapiens
atatatatatattttttatatatatat

SEQ ID NO: 79973 - DNA, 20 bp, Homo sapiens
atatatatatatatatatat

SEQ ID NO: 79974 - DNA, 19 bp, Homo sapiens
taatatatataatatatac

SEQ ID NO: 79975 - DNA, 29 bp, Homo sapiens
tatatatatttattttatatatatatata

SEQ ID NO: 79976 - DNA, 22 bp, Homo sapiens
atatatatatatatttatatat

SEQ ID NO: 79977 - DNA, 23 bp, Homo sapiens
atatatatatatatattatatat

SEQ ID NO: 79978 - DNA, 22 bp, Homo sapiens
atatatatatatatatatatat

SEQ ID NO: 79979 - DNA, 21 bp, Homo sapiens
tatatatatatatatatatat

SEQ ID NO: 79980 - DNA, 19 bp, Homo sapiens
tatatatatatatatatat

SEQ ID NO: 79981 - DNA, 20 bp, Homo sapiens
tatatatatatatatcacat

SEQ ID NO: 79982 - DNA, 24 bp, Homo sapiens
atatatatatatatggatatatat

SEQ ID NO: 79983 - DNA, 22 bp, Homo sapiens
atatatatatatatggatatat

SEQ ID NO: 79984 - DNA, 26 bp, Homo sapiens
atatatatatgggatatatatatata

SEQ ID NO: 79985 - DNA, 25 bp, Homo sapiens
atatatatgggatatatatatatat

SEQ ID NO: 79986 - DNA, 24 bp, Homo sapiens
aatatatatgtatatatatatata

SEQ ID NO: 79987 - DNA, 19 bp, Homo sapiens
tacatatatatatatatat

SEQ ID NO: 79988 - DNA, 25 bp, Homo sapiens
taaaatatatatatatatatatata

SEQ ID NO: 79989 - DNA, 24 bp, Homo sapiens
aatatatatatatatatatatata

SEQ ID NO: 79990 - DNA, 22 bp, Homo sapiens
atatatatatatatgtatatat

SEQ ID NO: 79991 - DNA, 22 bp, Homo sapiens
atatatatatatatatgtatat

SEQ ID NO: 79992 - DNA, 23 bp, Homo sapiens
tatatatatatgtatatatatat

SEQ ID NO: 79993 - DNA, 20 bp, Homo sapiens
taatatatatgtatatacat

SEQ ID NO: 79994 - DNA, 19 bp, Homo sapiens
catatatatatatacatat

SEQ ID NO: 79995 - DNA, 23 bp, Homo sapiens
aatatatatatatgtatatataa

SEQ ID NO: 79996 - DNA, 22 bp, Homo sapiens
atatgtatatatatatatatat

SEQ ID NO: 79997 - DNA, 24 bp, Homo sapiens
aatatatatatatgtatatatata

SEQ ID NO: 79998 - DNA, 22 bp, Homo sapiens
atatatatatgtatatatatat

SEQ ID NO: 79999 - DNA, 22 bp, Homo sapiens
atatatatgtatatatatatat

SEQ ID NO: 80000 - DNA, 22 bp, Homo sapiens
atatatgtatatatatatatat

SEQ ID NO: 80001 - DNA, 22 bp, Homo sapiens
atatacgtatatatatatatat

SEQ ID NO: 80002 - DNA, 22 bp, Homo sapiens
atatatacgtatatatatatat

SEQ ID NO: 80003 - DNA, 22 bp, Homo sapiens
tatatatatatatatatatata

SEQ ID NO: 80004 - DNA, 20 bp, Homo sapiens
atatgtatatacatatatat

SEQ ID NO: 80005 - DNA, 21 bp, Homo sapiens
tatatatatttatatatatat

SEQ ID NO: 80006 - DNA, 20 bp, Homo sapiens
taatatatatttatatatat

SEQ ID NO: 80007 - DNA, 26 bp, Homo sapiens
aatatatatatataatagatatatat

SEQ ID NO: 80008 - DNA, 20 bp, Homo sapiens
tatatatatattatatatat

SEQ ID NO: 80009 - DNA, 19 bp, Homo sapiens
tatatatatgcatatatat

SEQ ID NO: 80010 - DNA, 19 bp, Homo sapiens
tatatatatagatatatat

SEQ ID NO: 80011 - DNA, 22 bp, Homo sapiens
tatatatatatatgtatatata

SEQ ID NO: 80012 - DNA, 19 bp, Homo sapiens
tatatatatgtatatatac

SEQ ID NO: 80013 - DNA, 24 bp, Homo sapiens
aatatatattatacatatatatat

SEQ ID NO: 80014 - DNA, 25 bp, Homo sapiens
aatatatatatatatgtatatatat

SEQ ID NO: 80015 - DNA, 22 bp, Homo sapiens
atatatatatatgtatatatat

SEQ ID NO: 80016 - DNA, 22 bp, Homo sapiens
taatatatattcatatatatat

SEQ ID NO: 80017 - DNA, 22 bp, Homo sapiens
taagatatatatatatatatat

SEQ ID NO: 80018 - DNA, 26 bp, Homo sapiens
taacaaatatatatgtatatatatat

SEQ ID NO: 80019 - DNA, 21 bp, Homo sapiens
tatatacacacatatgtatat

SEQ ID NO: 80020 - DNA, 19 bp, Homo sapiens
tatatatatatttatatat

SEQ ID NO: 80021 - DNA, 22 bp, Homo sapiens
tatatatatgtatatatatata

SEQ ID NO: 80022 - DNA, 22 bp, Homo sapiens
acacacatatatatatatatat

SEQ ID NO: 80023 - DNA, 22 bp, Homo sapiens
tatatatatctcatatatatat

SEQ ID NO: 80024 - DNA, 22 bp, Homo sapiens
acataaatatatatgtatatat

SEQ ID NO: 80025 - DNA, 24 bp, Homo sapiens
atatatatatatatatgtatatat

SEQ ID NO: 80026 - DNA, 18 bp, Homo sapiens
taatatatatatatatat

SEQ ID NO: 80027 - DNA, 23 bp, Homo sapiens
atatatatctattatatatatat

SEQ ID NO: 80028 - DNA, 22 bp, Homo sapiens
atatatatatatatacatatat

SEQ ID NO: 80029 - DNA, 22 bp, Homo sapiens
atatatatacatatatatatat

SEQ ID NO: 80030 - DNA, 20 bp, Homo sapiens
atatatatgtatatatatat

SEQ ID NO: 80031 - DNA, 22 bp, Homo sapiens
atatatatatacatatatatat

SEQ ID NO: 80032 - DNA, 22 bp, Homo sapiens
atatatacatatatatatatat

SEQ ID NO: 80033 - DNA, 22 bp, Homo sapiens
atatgtatatatatatgtatat

SEQ ID NO: 80034 - DNA, 19 bp, Homo sapiens
tatatatatatgtatatat

SEQ ID NO: 80035 - DNA, 22 bp, Homo sapiens
atatatatatatacatatatat

SEQ ID NO: 80036 - DNA, 21 bp, Homo sapiens
tatatatatatgtatatatat

SEQ ID NO: 80037 - DNA, 19 bp, Homo sapiens
tatatatatatataaatat

SEQ ID NO: 80038 - DNA, 22 bp, Homo sapiens
atatatataaatatatatatat

SEQ ID NO: 80039 - DNA, 22 bp, Homo sapiens
atatatatataaatatatatat

SEQ ID NO: 80040 - DNA, 22 bp, Homo sapiens
aatatatatatatataaaatat

SEQ ID NO: 80041 - DNA, 22 bp, Homo sapiens
atatataaatatatatatatat

SEQ ID NO: 80042 - DNA, 20 bp, Homo sapiens
taatatatacatatatacat

SEQ ID NO: 80043 - DNA, 22 bp, Homo sapiens
atatatacatacatatatatat

SEQ ID NO: 80044 - DNA, 21 bp, Homo sapiens
tacatatatatatacatatat

SEQ ID NO: 80045 - DNA, 20 bp, Homo sapiens
acatatatatatacatatat

SEQ ID NO: 80046 - DNA, 24 bp, Homo sapiens
taatatatatatatgtatatataa

SEQ ID NO: 80047 - DNA, 22 bp, Homo sapiens
acatgtatgtatacacatatat

SEQ ID NO: 80048 - DNA, 22 bp, Homo sapiens
tatatatatactttatatatat

SEQ ID NO: 80049 - DNA, 22 bp, Homo sapiens
atacatatatatatatatatat

SEQ ID NO: 80050 - DNA, 19 bp, Homo sapiens
tatatatgtatatatatac

SEQ ID NO: 80051 - DNA, 23 bp, Homo sapiens
atacatattatatatatatatat

SEQ ID NO: 80052 - DNA, 23 bp, Homo sapiens
atatatatatatataaaatatat

SEQ ID NO: 80053 - DNA, 18 bp, Homo sapiens
tatatatatatatatata

SEQ ID NO: 80054 - DNA, 23 bp, Homo sapiens
atatacatattatatatatatat

SEQ ID NO: 80055 - DNA, 22 bp, Homo sapiens
caatatatatatatatacatat

SEQ ID NO: 80056 - DNA, 23 bp, Homo sapiens
atatatacatattatatatatat

SEQ ID NO: 80057 - DNA, 23 bp, Homo sapiens
acatattatatatatatatatat

SEQ ID NO: 80058 - DNA, 21 bp, Homo sapiens
tatgtatatatacacatatat

SEQ ID NO: 80059 - DNA, 23 bp, Homo sapiens
tatatatatagcactatatatat

SEQ ID NO: 80060 - DNA, 27 bp, Homo sapiens
taatatacatatatgtagaatatatat

SEQ ID NO: 80061 - DNA, 22 bp, Homo sapiens
tatatatatatatatgtatata

SEQ ID NO: 80062 - DNA, 21 bp, Homo sapiens
tatatatatatgcatatatat

SEQ ID NO: 80063 - DNA, 22 bp, Homo sapiens
atatatatatatatatatataa

SEQ ID NO: 80064 - DNA, 23 bp, Homo sapiens
atatatatatatatatatatata

SEQ ID NO: 80065 - DNA, 22 bp, Homo sapiens
tatatatatatatgaaatatat

SEQ ID NO: 80066 - DNA, 20 bp, Homo sapiens
aatatatacagtatatatat

SEQ ID NO: 80067 - DNA, 19 bp, Homo sapiens
aatatatatataaatatat

SEQ ID NO: 80068 - DNA, 25 bp, Homo sapiens
atatatatatatgaaatatatatat

SEQ ID NO: 80069 - DNA, 21 bp, Homo sapiens
tatttatatatatatatatat

SEQ ID NO: 80070 - DNA, 19 bp, Homo sapiens
tatatatatacatatatat

SEQ ID NO: 80071 - DNA, 22 bp, Homo sapiens
catatatatatatatatatata

SEQ ID NO: 80072 - DNA, 18 bp, Homo sapiens
atatatatatatatatat

SEQ ID NO: 80073 - DNA, 22 bp, Homo sapiens
atatatatatatatacacacat

SEQ ID NO: 80074 - DNA, 23 bp, Homo sapiens
aatatatatatatatatatataa

SEQ ID NO: 80075 - DNA, 25 bp, Homo sapiens
taatatatatatatatatatatata

SEQ ID NO: 80076 - DNA, 24 bp, Homo sapiens
taatatatatatatatatatataa

SEQ ID NO: 80077 - DNA, 22 bp, Homo sapiens
atatatatttatttatatatat

SEQ ID NO: 80078 - DNA, 19 bp, Homo sapiens
tatatatatttatatatat

SEQ ID NO: 80079 - DNA, 21 bp, Homo sapiens
aatatatacatatatatatat

SEQ ID NO: 80080 - DNA, 22 bp, Homo sapiens
atatacatatatatatatatat

SEQ ID NO: 80081 - DNA, 19 bp, Homo sapiens
tatatatatgtatatatat

SEQ ID NO: 80082 - DNA, 20 bp, Homo sapiens
atacagatatatatatatat

SEQ ID NO: 80083 - DNA, 22 bp, Homo sapiens
atatatatatttacatatatat

SEQ ID NO: 80084 - DNA, 21 bp, Homo sapiens
aatatatatatatatatatat

SEQ ID NO: 80085 - DNA, 23 bp, Homo sapiens
ataaatatatatatatatatata

SEQ ID NO: 80086 - DNA, 24 bp, Homo sapiens
taatttatatatatatatgcatat

SEQ ID NO: 80087 - DNA, 19 bp, Homo sapiens
tatataaatatatatatat

SEQ ID NO: 80088 - DNA, 21 bp, Homo sapiens
aatatatatctacatatatat

SEQ ID NO: 80089 - DNA, 22 bp, Homo sapiens
atagatatatatatatatatat

SEQ ID NO: 80090 - DNA, 23 bp, Homo sapiens
atatatatatatataatatatat

SEQ ID NO: 80091 - DNA, 22 bp, Homo sapiens
atacaaatatatatatatatat

SEQ ID NO: 80092 - DNA, 23 bp, Homo sapiens
taatatatatattccatatatat

SEQ ID NO: 80093 - DNA, 23 bp, Homo sapiens
taatatacatattccatatatat

SEQ ID NO: 80094 - DNA, 23 bp, Homo sapiens
aataaaaatatatatatatatat

SEQ ID NO: 80095 - DNA, 20 bp, Homo sapiens
tatatatataatatatatat

SEQ ID NO: 80096 - DNA, 21 bp, Homo sapiens
tatatatataaaaatatatat

SEQ ID NO: 80097 - DNA, 23 bp, Homo sapiens
atatatatataaaatatatatat

SEQ ID NO: 80098 - DNA, 19 bp, Homo sapiens
atatataatatatatatat

SEQ ID NO: 80099 - DNA, 23 bp, Homo sapiens
atatatataatatatatatatat

SEQ ID NO: 80100 - DNA, 22 bp, Homo sapiens
aatatatatattttatatatat

SEQ ID NO: 80101 - DNA, 22 bp, Homo sapiens
ataaacatatatatatatatat

SEQ ID NO: 80102 - DNA, 22 bp, Homo sapiens
acacatatatgtatatatatat

SEQ ID NO: 80103 - DNA, 22 bp, Homo sapiens
acatatatatatttatatatat

SEQ ID NO: 80104 - DNA, 22 bp, Homo sapiens
atatatacgtacatatatatat

SEQ ID NO: 80105 - DNA, 21 bp, Homo sapiens
tacatatatatttatatatat

SEQ ID NO: 80106 - DNA, 21 bp, Homo sapiens
tatatatatgtatatatataa

SEQ ID NO: 80107 - DNA, 20 bp, Homo sapiens
atatatatatatatattaca

SEQ ID NO: 80108 - DNA, 19 bp, Homo sapiens
aatatatatatatatatat

SEQ ID NO: 80109 - DNA, 23 bp, Homo sapiens
taatatatttatataatatatat

SEQ ID NO: 80110 - DNA, 21 bp, Homo sapiens
catatatatatatatatatat

SEQ ID NO: 80111 - DNA, 24 bp, Homo sapiens
atatatatatcccacatatatata

SEQ ID NO: 80112 - DNA, 19 bp, Homo sapiens
tatatatacacatgtatat

SEQ ID NO: 80113 - DNA, 20 bp, Homo sapiens
atatatatacacatgtatat

SEQ ID NO: 80114 - DNA, 19 bp, Homo sapiens
catatatatatatatatat

SEQ ID NO: 80115 - DNA, 21 bp, Homo sapiens
tatatatatacacatgtatat

SEQ ID NO: 80116 - DNA, 24 bp, Homo sapiens
taatatatattacatagtatatat

SEQ ID NO: 80117 - DNA, 21 bp, Homo sapiens
tatatatttatatatatatat

SEQ ID NO: 80118 - DNA, 22 bp, Homo sapiens
atatatatatgcatatatatat

SEQ ID NO: 80119 - DNA, 19 bp, Homo sapiens
aataaatatatatatatat

SEQ ID NO: 80120 - DNA, 23 bp, Homo sapiens
acacatatatatatatatatata

SEQ ID NO: 80121 - DNA, 21 bp, Homo sapiens
tatacacatatatatatataa

SEQ ID NO: 80122 - DNA, 22 bp, Homo sapiens
atatatgcatatatatatatat

SEQ ID NO: 80123 - DNA, 22 bp, Homo sapiens
atatatatatatatgcatatat

SEQ ID NO: 80124 - DNA, 23 bp, Homo sapiens
atacacatatatatatatatata

SEQ ID NO: 80125 - DNA, 22 bp, Homo sapiens
atatatatatatgtatgtatat

SEQ ID NO: 80126 - DNA, 22 bp, Homo sapiens
atatgcatatatatatatatat

SEQ ID NO: 80127 - DNA, 22 bp, Homo sapiens
tatacacatatatatatatata

SEQ ID NO: 80128 - DNA, 23 bp, Homo sapiens
acatatatatatatatatatata

SEQ ID NO: 80129 - DNA, 22 bp, Homo sapiens
atatatatgcatatatatatat

SEQ ID NO: 80130 - DNA, 20 bp, Homo sapiens
atatatatatatatatgtat

SEQ ID NO: 80131 - DNA, 22 bp, Homo sapiens
atatatatatatgcatatatat

SEQ ID NO: 80132 - DNA, 23 bp, Homo sapiens
atatatactcacatatatatata

SEQ ID NO: 80133 - DNA, 23 bp, Homo sapiens
tatatatactcacatatatatat

SEQ ID NO: 80134 - DNA, 22 bp, Homo sapiens
atatatatatataaatatatat

SEQ ID NO: 80135 - DNA, 25 bp, Homo sapiens
caatatatatatatatatatatata

SEQ ID NO: 80136 - DNA, 22 bp, Homo sapiens
atatatacatatctatatatat

SEQ ID NO: 80137 - DNA, 27 bp, Homo sapiens
atatatatatgagaatatatatatata

SEQ ID NO: 80138 - DNA, 22 bp, Homo sapiens
tatcagctatatatatatatat

SEQ ID NO: 80139 - DNA, 27 bp, Homo sapiens
atatatatatatgagaatatatatata

SEQ ID NO: 80140 - DNA, 19 bp, Homo sapiens
tatatatatacatgtatat

SEQ ID NO: 80141 - DNA, 21 bp, Homo sapiens
tacatacatatatatatataa

SEQ ID NO: 80142 - DNA, 23 bp, Homo sapiens
acatacatatatatatatatata

SEQ ID NO: 80143 - DNA, 22 bp, Homo sapiens
tacatacatatatatatatata

SEQ ID NO: 80144 - DNA, 23 bp, Homo sapiens
atacatatatatatatatatata

SEQ ID NO: 80145 - DNA, 21 bp, Homo sapiens
tatatatatctatatatatat

SEQ ID NO: 80146 - DNA, 22 bp, Homo sapiens
catatatatatataatatatat

SEQ ID NO: 80147 - DNA, 21 bp, Homo sapiens
tatatatatatatataaacat

SEQ ID NO: 80148 - DNA, 21 bp, Homo sapiens
aataaatatatatatatatat

SEQ ID NO: 80149 - DNA, 19 bp, Homo sapiens
catatatttatatatatat

SEQ ID NO: 80150 - DNA, 20 bp, Homo sapiens
taaaatatatatatatatat

SEQ ID NO: 80151 - DNA, 23 bp, Homo sapiens
atatatatatatgtatcatatat

SEQ ID NO: 80152 - DNA, 20 bp, Homo sapiens
atatatacatatacacatat

SEQ ID NO: 80153 - DNA, 21 bp, Homo sapiens
tatgtatatatatatatatat

SEQ ID NO: 80154 - DNA, 22 bp, Homo sapiens
atatatatatgtatgtatatat

SEQ ID NO: 80155 - DNA, 19 bp, Homo sapiens
tatgtatatatatatatat

SEQ ID NO: 80156 - DNA, 22 bp, Homo sapiens
atatgtatgtatatatatatat

SEQ ID NO: 80157 - DNA, 22 bp, Homo sapiens
atatatgtatgtatatatatat

SEQ ID NO: 80158 - DNA, 22 bp, Homo sapiens
atatatatgtatgtatatatat

SEQ ID NO: 80159 - DNA, 19 bp, Homo sapiens
tatatatctatatatatat

SEQ ID NO: 80160 - DNA, 22 bp, Homo sapiens
atacactcatatatatgtatat

SEQ ID NO: 80161 - DNA, 22 bp, Homo sapiens
atatatatgtatatgtacatat

SEQ ID NO: 80162 - DNA, 22 bp, Homo sapiens
atatatatatatatatacatat

SEQ ID NO: 80163 - DNA, 19 bp, Homo sapiens
tacatatgtatatatatat

SEQ ID NO: 80164 - DNA, 19 bp, Homo sapiens
tatatacatacatatatat

SEQ ID NO: 80165 - DNA, 22 bp, Homo sapiens
atatgtatatatacacacatat

SEQ ID NO: 80166 - DNA, 24 bp, Homo sapiens
taacatatatattatattatatat

SEQ ID NO: 80167 - DNA, 22 bp, Homo sapiens
atatatatatatttatatatat

SEQ ID NO: 80168 - DNA, 20 bp, Homo sapiens
atatgtatatatacatatat

SEQ ID NO: 80169 - DNA, 19 bp, Homo sapiens
tatatatatccatatatat

SEQ ID NO: 80170 - DNA, 22 bp, Homo sapiens
atatatccatatatatatatat

SEQ ID NO: 80171 - DNA, 19 bp, Homo sapiens
tatgtatatatacatatat

SEQ ID NO: 80172 - DNA, 22 bp, Homo sapiens
atatacatatatatgtatatat

SEQ ID NO: 80173 - DNA, 22 bp, Homo sapiens
atatatgtatatatacatatat

SEQ ID NO: 80174 - DNA, 22 bp, Homo sapiens
atatccatatatatatatatat

SEQ ID NO: 80175 - DNA, 21 bp, Homo sapiens
tatatatatatacatatatat

SEQ ID NO: 80176 - DNA, 21 bp, Homo sapiens
tatatatatccatatatatat

SEQ ID NO: 80177 - DNA, 22 bp, Homo sapiens
atatatatatatatccatatat

SEQ ID NO: 80178 - DNA, 22 bp, Homo sapiens
atatatatatccatatatatat

SEQ ID NO: 80179 - DNA, 22 bp, Homo sapiens
atatatatccatatatatatat

SEQ ID NO: 80180 - DNA, 22 bp, Homo sapiens
atatatatatatccatatatat

SEQ ID NO: 80181 - DNA, 24 bp, Homo sapiens
atacatacatatgtgtatatatat

SEQ ID NO: 80182 - DNA, 22 bp, Homo sapiens
atatgtatatatatatacacat

SEQ ID NO: 80183 - DNA, 21 bp, Homo sapiens
tatatatatgtatatatatat

SEQ ID NO: 80184 - DNA, 23 bp, Homo sapiens
atatatatcatatatatatatat

SEQ ID NO: 80185 - DNA, 24 bp, Homo sapiens
aatatatatatatgtatgtatata

SEQ ID NO: 80186 - DNA, 20 bp, Homo sapiens
acatatatatatatatatat

SEQ ID NO: 80187 - DNA, 26 bp, Homo sapiens
atatatatgtaatatatatatatata

SEQ ID NO: 80188 - DNA, 23 bp, Homo sapiens
atatgtatattacatatatatat

SEQ ID NO: 80189 - DNA, 24 bp, Homo sapiens
atatgtatattacatatatatata

SEQ ID NO: 80190 - DNA, 19 bp, Homo sapiens
tatatatatatatatacat

SEQ ID NO: 80191 - DNA, 20 bp, Homo sapiens
atatttatatatatatatat

SEQ ID NO: 80192 - DNA, 19 bp, Homo sapiens
tacatatatattatatata

SEQ ID NO: 80193 - DNA, 22 bp, Homo sapiens
atatatatatatatataaacat

SEQ ID NO: 80194 - DNA, 24 bp, Homo sapiens
atacatatgtatatatatatatat

SEQ ID NO: 80195 - DNA, 22 bp, Homo sapiens
acatatgtatatatatatatat

SEQ ID NO: 80196 - DNA, 20 bp, Homo sapiens
tatatatatatataaaatat

SEQ ID NO: 80197 - DNA, 24 bp, Homo sapiens
atatatacctgtatatatatatat

SEQ ID NO: 80198 - DNA, 22 bp, Homo sapiens
atatatatgtatatatgtatat

SEQ ID NO: 80199 - DNA, 21 bp, Homo sapiens
tatatatgtatatacatatat

SEQ ID NO: 80200 - DNA, 19 bp, Homo sapiens
tatatacatatatatatat

SEQ ID NO: 80201 - DNA, 19 bp, Homo sapiens
tatatatatctatatatat

SEQ ID NO: 80202 - DNA, 22 bp, Homo sapiens
atatatgtatatacatatatat

SEQ ID NO: 80203 - DNA, 21 bp, Homo sapiens
tatatatccatatatatatat

SEQ ID NO: 80204 - DNA, 23 bp, Homo sapiens
atatatatatatatatgtatata

SEQ ID NO: 80205 - DNA, 22 bp, Homo sapiens
atatgtatatacatatatatat

SEQ ID NO: 80206 - DNA, 19 bp, Homo sapiens
tatatatccatatatatat

SEQ ID NO: 80207 - DNA, 20 bp, Homo sapiens
atatatatatatgtatatat

SEQ ID NO: 80208 - DNA, 21 bp, Homo sapiens
tatatatatatgtatatataa

SEQ ID NO: 80209 - DNA, 22 bp, Homo sapiens
tatatatatatgtatatatata

SEQ ID NO: 80210 - DNA, 20 bp, Homo sapiens
tatatatatatatatagcac

SEQ ID NO: 80211 - DNA, 22 bp, Homo sapiens
taatatatatatatttatatat

SEQ ID NO: 80212 - DNA, 19 bp, Homo sapiens
tatatataatatatatata

SEQ ID NO: 80213 - DNA, 20 bp, Homo sapiens
atatatacacacatatatat

SEQ ID NO: 80214 - DNA, 24 bp, Homo sapiens
atatatatacacacatatatatat

SEQ ID NO: 80215 - DNA, 22 bp, Homo sapiens
atatatatacacacatatatat

SEQ ID NO: 80216 - DNA, 22 bp, Homo sapiens
acacatatatatatatatatat

SEQ ID NO: 80217 - DNA, 19 bp, Homo sapiens
tatatacacacatatatat

SEQ ID NO: 80218 - DNA, 23 bp, Homo sapiens
atatatatttatatatatatata

SEQ ID NO: 80219 - DNA, 20 bp, Homo sapiens
taatatatacatatagctat

SEQ ID NO: 80220 - DNA, 18 bp, Homo sapiens
aatatatatatatataca

SEQ ID NO: 80221 - DNA, 24 bp, Homo sapiens
aataaatatatatatatatatata

SEQ ID NO: 80222 - DNA, 23 bp, Homo sapiens
atatatttatatatatatatata

SEQ ID NO: 80223 - DNA, 22 bp, Homo sapiens
cacatatatatgtatatatata

SEQ ID NO: 80224 - DNA, 23 bp, Homo sapiens
acatatatatgtatatatatata

SEQ ID NO: 80225 - DNA, 22 bp, Homo sapiens
atatatatatatgtatatataa

SEQ ID NO: 80226 - DNA, 23 bp, Homo sapiens
atatatatatatgtatatatata

SEQ ID NO: 80227 - DNA, 22 bp, Homo sapiens
atatagatatatatatatatat

SEQ ID NO: 80228 - DNA, 22 bp, Homo sapiens
atatatgtatatatgtatatat

SEQ ID NO: 80229 - DNA, 19 bp, Homo sapiens
taatattatatatatatat

SEQ ID NO: 80230 - DNA, 22 bp, Homo sapiens
acacatatgtatatgtatatat

SEQ ID NO: 80231 - DNA, 23 bp, Homo sapiens
atatacacatatatatatatata

SEQ ID NO: 80232 - DNA, 24 bp, Homo sapiens
atatatatacacatatatatatat

SEQ ID NO: 80233 - DNA, 21 bp, Homo sapiens
tatatatatatatacacatat

SEQ ID NO: 80234 - DNA, 23 bp, Homo sapiens
atatatacacatatatatatata

SEQ ID NO: 80235 - DNA, 19 bp, Homo sapiens
tatatatatacaagtatat

SEQ ID NO: 80236 - DNA, 23 bp, Homo sapiens
aatatatatgcatatatatatat

SEQ ID NO: 80237 - DNA, 19 bp, Homo sapiens
tatatatatatatatatac

SEQ ID NO: 80238 - DNA, 21 bp, Homo sapiens
catatatatatatatatataa

SEQ ID NO: 80239 - DNA, 19 bp, Homo sapiens
tacatatatatacacatat

SEQ ID NO: 80240 - DNA, 25 bp, Homo sapiens
taatatatattatatatatatatat

SEQ ID NO: 80241 - DNA, 21 bp, Homo sapiens
tatatatatatatatgtacat

SEQ ID NO: 80242 - DNA, 29 bp, Homo sapiens
taatatatatatgtgcacatatatatata

SEQ ID NO: 80243 - DNA, 22 bp, Homo sapiens
atatatatatatatatttatat

SEQ ID NO: 80244 - DNA, 21 bp, Homo sapiens
tatatatatatatgtatataa

SEQ ID NO: 80245 - DNA, 19 bp, Homo sapiens
taatatatatataaataca

SEQ ID NO: 80246 - DNA, 23 bp, Homo sapiens
aatatatatgtatatatatataa

SEQ ID NO: 80247 - DNA, 19 bp, Homo sapiens
aatatatataaatatatat

SEQ ID NO: 80248 - DNA, 21 bp, Homo sapiens
tatatatatatatatttatat

SEQ ID NO: 80249 - DNA, 20 bp, Homo sapiens
tatatatatgtatatataca

SEQ ID NO: 80250 - DNA, 22 bp, Homo sapiens
atatgtatacgtatatatatat

SEQ ID NO: 80251 - DNA, 21 bp, Homo sapiens
tatatttatatatatatatat

SEQ ID NO: 80252 - DNA, 23 bp, Homo sapiens
tatatatatatatttgtatatat

SEQ ID NO: 80253 - DNA, 24 bp, Homo sapiens
taatatatatatatatatttatat

SEQ ID NO: 80254 - DNA, 22 bp, Homo sapiens
tatataatatatatatatatat

SEQ ID NO: 80255 - DNA, 19 bp, Homo sapiens
tatatatatgtacacacat

SEQ ID NO: 80256 - DNA, 22 bp, Homo sapiens
acatatatttatatatatatat

SEQ ID NO: 80257 - DNA, 23 bp, Homo sapiens
atatataaaacatatatatatat

SEQ ID NO: 80258 - DNA, 28 bp, Homo sapiens
taatatatatatttttatatatatatat

SEQ ID NO: 80259 - DNA, 21 bp, Homo sapiens
aatatatatatgtatatatat

SEQ ID NO: 80260 - DNA, 19 bp, Homo sapiens
tatacatatatatatgtat

SEQ ID NO: 80261 - DNA, 21 bp, Homo sapiens
tacatatatatatgtatacat

SEQ ID NO: 80262 - DNA, 21 bp, Homo sapiens
tacatatatgtatacatatat

SEQ ID NO: 80263 - DNA, 22 bp, Homo sapiens
tatatatatatatattatatat

SEQ ID NO: 80264 - DNA, 24 bp, Homo sapiens
taatatatatatactgtaacacat

SEQ ID NO: 80265 - DNA, 21 bp, Homo sapiens
tatatatatatttatatatat

SEQ ID NO: 80266 - DNA, 19 bp, Homo sapiens
catatatacatatatatat

SEQ ID NO: 80267 - DNA, 22 bp, Homo sapiens
atatatttatatatatatatat

SEQ ID NO: 80268 - DNA, 22 bp, Homo sapiens
tatatatatacatctatatata

SEQ ID NO: 80269 - DNA, 27 bp, Homo sapiens
atatatatattttcatatatatatata

SEQ ID NO: 80270 - DNA, 22 bp, Homo sapiens
atatatatatacatacatatat

SEQ ID NO: 80271 - DNA, 27 bp, Homo sapiens
atatatatatattttcatatatatata

SEQ ID NO: 80272 - DNA, 20 bp, Homo sapiens
ataaatatatatatatatat

SEQ ID NO: 80273 - DNA, 23 bp, Homo sapiens
atatatatatatatcagctatat

SEQ ID NO: 80274 - DNA, 22 bp, Homo sapiens
acatatatatttccatatatat

SEQ ID NO: 80275 - DNA, 20 bp, Homo sapiens
tatatatatatataaaacat

SEQ ID NO: 80276 - DNA, 19 bp, Homo sapiens
aatatatacatatatatat

SEQ ID NO: 80277 - DNA, 22 bp, Homo sapiens
acatatatatctatatgtatat

SEQ ID NO: 80278 - DNA, 27 bp, Homo sapiens
aatatatatgtatgtacatatatatat

SEQ ID NO: 80279 - DNA, 23 bp, Homo sapiens
atatatatataatatatatatat

SEQ ID NO: 80280 - DNA, 25 bp, Homo sapiens
aatatatctttatatatatatatat

SEQ ID NO: 80281 - DNA, 24 bp, Homo sapiens
aatatatatatgtatgtatatata

SEQ ID NO: 80282 - DNA, 21 bp, Homo sapiens
aatatatatatatatatgtat

SEQ ID NO: 80283 - DNA, 23 bp, Homo sapiens
taatatatataatatatttatat

SEQ ID NO: 80284 - DNA, 21 bp, Homo sapiens
tatatatatacacgtatatat

SEQ ID NO: 80285 - DNA, 20 bp, Homo sapiens
atatatacacacgtatatat

SEQ ID NO: 80286 - DNA, 19 bp, Homo sapiens
tatatatatacacgtatat

SEQ ID NO: 80287 - DNA, 19 bp, Homo sapiens
tacatatatatactatata

SEQ ID NO: 80288 - DNA, 23 bp, Homo sapiens
atatatattatatatatgtatat

SEQ ID NO: 80289 - DNA, 19 bp, Homo sapiens
tatatgtatacatatatat

SEQ ID NO: 80290 - DNA, 22 bp, Homo sapiens
atatgtatatgtatacatatat

SEQ ID NO: 80291 - DNA, 22 bp, Homo sapiens
ataaatatatatatatatatat

SEQ ID NO: 80292 - DNA, 19 bp, Homo sapiens
tacatatatatgtacatat

SEQ ID NO: 80293 - DNA, 22 bp, Homo sapiens
atatatgtatatatatttatat

SEQ ID NO: 80294 - DNA, 25 bp, Homo sapiens
taatatgtatatatgtatatatata

SEQ ID NO: 80295 - DNA, 19 bp, Homo sapiens
tatatatatatacacacat

SEQ ID NO: 80296 - DNA, 21 bp, Homo sapiens
tatatatgtatacacacatat

SEQ ID NO: 80297 - DNA, 20 bp, Homo sapiens
caatatatatttatatatat

SEQ ID NO: 80298 - DNA, 23 bp, Homo sapiens
catacacacatatgtgtatatat

SEQ ID NO: 80299 - DNA, 22 bp, Homo sapiens
atatatatatatatatacacat

SEQ ID NO: 80300 - DNA, 22 bp, Homo sapiens
acagatatatatatatatatat

SEQ ID NO: 80301 - DNA, 21 bp, Homo sapiens
tatatacatacatgtatatat

SEQ ID NO: 80302 - DNA, 20 bp, Homo sapiens
taatatatatatatatatat

SEQ ID NO: 80303 - DNA, 21 bp, Homo sapiens
atatatatatatatattatat

SEQ ID NO: 80304 - DNA, 28 bp, Homo sapiens
atatatatatatattatttatatatata

SEQ ID NO: 80305 - DNA, 27 bp, Homo sapiens
atatatatatattatttatatatatat

SEQ ID NO: 80306 - DNA, 22 bp, Homo sapiens
taatatatttatatatatatat

SEQ ID NO: 80307 - DNA, 21 bp, Homo sapiens
tatatatatatatttatatat

SEQ ID NO: 80308 - DNA, 24 bp, Homo sapiens
aatatatatatataatatatatat

SEQ ID NO: 80309 - DNA, 24 bp, Homo sapiens
taatatatattttcatatatatat

SEQ ID NO: 80310 - DNA, 22 bp, Homo sapiens
tacataaattatatatatatat

SEQ ID NO: 80311 - DNA, 23 bp, Homo sapiens
taatacataacatttatatatat

SEQ ID NO: 80312 - DNA, 23 bp, Homo sapiens
taacatatataacatttatatat

SEQ ID NO: 80313 - DNA, 23 bp, Homo sapiens
atatatatatatatagtatatat

SEQ ID NO: 80314 - DNA, 23 bp, Homo sapiens
atatatatatatatatagtatat

SEQ ID NO: 80315 - DNA, 23 bp, Homo sapiens
taatatatataacatttatatat

SEQ ID NO: 80316 - DNA, 25 bp, Homo sapiens
aatatatatatgtatatatatatat

SEQ ID NO: 80317 - DNA, 20 bp, Homo sapiens
aatatatatattatatatat

SEQ ID NO: 80318 - DNA, 21 bp, Homo sapiens
tatatacgtatatatatatat

SEQ ID NO: 80319 - DNA, 19 bp, Homo sapiens
tatatatatgtatacatac

SEQ ID NO: 80320 - DNA, 24 bp, Homo sapiens
aatatatatgtgtatatatatata

SEQ ID NO: 80321 - DNA, 19 bp, Homo sapiens
tatatatatatgtatacat

SEQ ID NO: 80322 - DNA, 21 bp, Homo sapiens
tatatacatacatatgtatat

SEQ ID NO: 80323 - DNA, 19 bp, Homo sapiens
tatatacgtatatatatat

SEQ ID NO: 80324 - DNA, 21 bp, Homo sapiens
tatatatgcatatatatatat

SEQ ID NO: 80325 - DNA, 19 bp, Homo sapiens
tatatatgcatatatatat

SEQ ID NO: 80326 - DNA, 19 bp, Homo sapiens
atatatatatatataatat

SEQ ID NO: 80327 - DNA, 21 bp, Homo sapiens
cataaatatatatatatatat

SEQ ID NO: 80328 - DNA, 23 bp, Homo sapiens
atacacattatatatatatatat

SEQ ID NO: 80329 - DNA, 23 bp, Homo sapiens
acacattatatatatatatatat

SEQ ID NO: 80330 - DNA, 23 bp, Homo sapiens
atatatacacattatatatatat

SEQ ID NO: 80331 - DNA, 19 bp, Homo sapiens
aatatatatatatacacat

SEQ ID NO: 80332 - DNA, 23 bp, Homo sapiens
atatacacattatatatatatat

SEQ ID NO: 80333 - DNA, 22 bp, Homo sapiens
atatatatatatatataacaca

SEQ ID NO: 80334 - DNA, 22 bp, Homo sapiens
atatatatgtatatacatatat

SEQ ID NO: 80335 - DNA, 24 bp, Homo sapiens
atatatatatatatgtgtatatat

SEQ ID NO: 80336 - DNA, 19 bp, Homo sapiens
tatatgtatatacatatat

SEQ ID NO: 80337 - DNA, 20 bp, Homo sapiens
atatatgtatatacatatat

SEQ ID NO: 80338 - DNA, 22 bp, Homo sapiens
atatatatgcacatatatatat

SEQ ID NO: 80339 - DNA, 22 bp, Homo sapiens
atatacatatatgtatatatat

SEQ ID NO: 80340 - DNA, 21 bp, Homo sapiens
tatatacatatatgtatatat

SEQ ID NO: 80341 - DNA, 23 bp, Homo sapiens
atatatatgcacatatatatata

SEQ ID NO: 80342 - DNA, 24 bp, Homo sapiens
atatatatatatgtgtatatatat

SEQ ID NO: 80343 - DNA, 24 bp, Homo sapiens
atatatatatgtgtatatatatat

SEQ ID NO: 80344 - DNA, 20 bp, Homo sapiens
taatatataatatatataca

SEQ ID NO: 80345 - DNA, 25 bp, Homo sapiens
catatatatatatgtgtatatatat

SEQ ID NO: 80346 - DNA, 22 bp, Homo sapiens
acacgtatatatatgtatatat

SEQ ID NO: 80347 - DNA, 24 bp, Homo sapiens
atatatgtgtatatatacatatat

SEQ ID NO: 80348 - DNA, 22 bp, Homo sapiens
atatatacccatatatatatat

SEQ ID NO: 80349 - DNA, 23 bp, Homo sapiens
acatatatattaaatatatatat

SEQ ID NO: 80350 - DNA, 20 bp, Homo sapiens
atatatatatatatgtatat

SEQ ID NO: 80351 - DNA, 22 bp, Homo sapiens
atatatatatgtatatgtatat

SEQ ID NO: 80352 - DNA, 21 bp, Homo sapiens
tatatatatatacacatatat

SEQ ID NO: 80353 - DNA, 19 bp, Homo sapiens
tatatatgtatacatatat

SEQ ID NO: 80354 - DNA, 25 bp, Homo sapiens
atacatacatatatgtgtatatata

SEQ ID NO: 80355 - DNA, 24 bp, Homo sapiens
atatatgtgtatatatatatatat

SEQ ID NO: 80356 - DNA, 27 bp, Homo sapiens
atacatatatatgtgtatatatatata

SEQ ID NO: 80357 - DNA, 20 bp, Homo sapiens
atatatatgtatacatatat

SEQ ID NO: 80358 - DNA, 24 bp, Homo sapiens
atatatatgtgtatatatatatat

SEQ ID NO: 80359 - DNA, 22 bp, Homo sapiens
atatatatatgtatacatatat

SEQ ID NO: 80360 - DNA, 25 bp, Homo sapiens
aatatatatatatatatatatatat

SEQ ID NO: 80361 - DNA, 27 bp, Homo sapiens
atatatatatatatggagatatatata

SEQ ID NO: 80362 - DNA, 20 bp, Homo sapiens
tatatatatattacatatat

SEQ ID NO: 80363 - DNA, 22 bp, Homo sapiens
atatatatatatgtacacacat

SEQ ID NO: 80364 - DNA, 22 bp, Homo sapiens
acatttatatatgtatatatat

SEQ ID NO: 80365 - DNA, 23 bp, Homo sapiens
atatgcatacatatatatatata

SEQ ID NO: 80366 - DNA, 22 bp, Homo sapiens
atatatatttatatatatatat

SEQ ID NO: 80367 - DNA, 22 bp, Homo sapiens
atatatatatttatatatatat

SEQ ID NO: 80368 - DNA, 20 bp, Homo sapiens
caatatattcatatatatat

SEQ ID NO: 80369 - DNA, 20 bp, Homo sapiens
acatatatacacacatatat

SEQ ID NO: 80370 - DNA, 91 bp, Human papillomavirus type 23
acatttgttggcaagaaaagagcaccgataacggtaagaacttttattttttgaccgtaggcgttcatttactaaccttggcaacaattgt

SEQ ID NO: 80371 - DNA, 24 bp, Human papillomavirus type 23
tgaccgtaggcgttcatttactaa

SEQ ID NO: 80372 - DNA, 23 bp, Homo sapiens
tgacttacaaagacatttactaa

SEQ ID NO: 80373 - DNA, 17 bp, Homo sapiens
tggccgtaggctcaccc

SEQ ID NO: 80374 - DNA, 62 bp, Human papillomavirus type 36
tgctatattcaagtttttgcctgtatcgttttcgtatcatgtgaataatatactgtatagta

SEQ ID NO: 80375 - DNA, 24 bp, Human papillomavirus type 36
tatcatgtgaataatatactgtat

SEQ ID NO: 80376 - DNA, 21 bp, Homo sapiens
tattacgtgaataatatctat

SEQ ID NO: 80377 - DNA, 18 bp, Homo sapiens
tgtgagtttatactgtat

SEQ ID NO: 80378 - DNA, 16 bp, Homo sapiens
atatgtatatactgta

SEQ ID NO: 80379 - DNA, 18 bp, Homo sapiens
atatgtacatatactgta

SEQ ID NO: 80380 - DNA, 19 bp, Homo sapiens
tgcaaaactaatatactgt

SEQ ID NO: 80381 - DNA, 17 bp, Homo sapiens
atgtgaatatgctgtat

SEQ ID NO: 80382 - DNA, 21 bp, Homo sapiens
tgcagaactaatatactgtat

SEQ ID NO: 80383 - DNA, 20 bp, Homo sapiens
atatgtcccgtatactgtat

SEQ ID NO: 80384 - DNA, 16 bp, Homo sapiens
atgtaaatgtactgta

SEQ ID NO: 80385 - DNA, 21 bp, Homo sapiens
tcatgtgaataagtaaagtat

SEQ ID NO: 80386 - DNA, 18 bp, Homo sapiens
catcgtgtggataataca

SEQ ID NO: 80387 - DNA, 19 bp, Homo sapiens
tgttgaatacacactgtat

SEQ ID NO: 80388 - DNA, 17 bp, Homo sapiens
atgtgttatatactgta

SEQ ID NO: 80389 - DNA, 20 bp, Homo sapiens
atgtgaagtgtgtactgtat

SEQ ID NO: 80390 - DNA, 72 bp, Human papillomavirus type 49
gcggtcacattatacttagtcatctcttgtggttgttaacaacaatcttgaaacagatatacatgtaaccgc

SEQ ID NO: 80391 - DNA, 24 bp, Human papillomavirus type 49
ttgaaacagatatacatgtaaccg

SEQ ID NO: 80392 - DNA, 15 bp, Homo sapiens
ttgaaacagaatgta

SEQ ID NO: 80393 - DNA, 18 bp, Homo sapiens
ctgggacaggtatacata

SEQ ID NO: 80394 - DNA, 20 bp, Homo sapiens
ttgaagcaaatatacccagc

SEQ ID NO: 80395 - DNA, 21 bp, Homo sapiens
ttgaaacatggtgtacatgta

SEQ ID NO: 80396 - DNA, 21 bp, Homo sapiens
ttgaaaaaaaacacatgtaac

SEQ ID NO: 80397 - DNA, 79 bp, Human papillomavirus type 9
acgtaggtggttatttgatcgttgggatgattgtggttaacaacaatctacatacacattttcatatgaccgccttcgt

SEQ ID NO: 80398 - DNA, 24 bp, Human papillomavirus type 9
aggtggttatttgatcgttgggat

SEQ ID NO: 80399 - DNA, 23 bp, Homo sapiens
aggtggctatttggtccccccag

SEQ ID NO: 80400 - DNA, 16 bp, Homo sapiens
agatggttatgttggg

SEQ ID NO: 80401 - DNA, 15 bp, Homo sapiens
aggggttattttggg

SEQ ID NO: 80402 - DNA, 19 bp, Homo sapiens
aggtggttgttgggttggg

SEQ ID NO: 80403 - DNA, 18 bp, Homo sapiens
aggtggttgtttatagga

SEQ ID NO: 80404 - DNA, 16 bp, Homo sapiens
aggaggtgtcgttggg

SEQ ID NO: 80405 - DNA, 70 bp, Vaccinia virus
gtaatactatctataaacataagtatataataaatactttttatttacggtactcttgtagtggtgatac

SEQ ID NO: 80406 - DNA, 24 bp, Vaccinia virus
tctataaacataagtatataataa

SEQ ID NO: 80407 - DNA, 17 bp, Homo sapiens
tctaaaaacataagaca

SEQ ID NO: 80408 - DNA, 19 bp, Homo sapiens
tccataaactatatataat

SEQ ID NO: 80409 - DNA, 24 bp, Homo sapiens
tccatggatataagtatacaataa

SEQ ID NO: 80410 - DNA, 21 bp, Homo sapiens
tctctaaacataaaatacaat

SEQ ID NO: 80411 - DNA, 21 bp, Homo sapiens
tacaaacagcatcatataata

SEQ ID NO: 80412 - DNA, 61 bp, Human herpesvirus 4
gcaatttgcctaacatggaggattgaggacccaccttttaattctcttctgtttgcattgc

SEQ ID NO: 80413 - DNA, 24 bp, Human herpesvirus 4
taacatggaggattgaggacccac

SEQ ID NO: 80414 - DNA, 20 bp, Homo sapiens
aacaaggggttggggactca

SEQ ID NO: 80415 - DNA, 19 bp, Homo sapiens
tggttggatttaggaccca

SEQ ID NO: 80416 - DNA, 23 bp, Homo sapiens
tgatgtcgactgcagggacccac

SEQ ID NO: 80417 - DNA, 17 bp, Homo sapiens
catggagggactcagcc

SEQ ID NO: 80418 - DNA, 19 bp, Homo sapiens
atggagggacaggacccac

SEQ ID NO: 80419 - DNA, 23 bp, Homo sapiens
caacatggccctaggggacccac

SEQ ID NO: 80420 - DNA, 16 bp, Homo sapiens
aacatgggggagggcc

SEQ ID NO: 80421 - DNA, 17 bp, Homo sapiens
atgcaggaagaacccac

SEQ ID NO: 80422 - DNA, 22 bp, Homo sapiens
catggagggcagcctggcccac

SEQ ID NO: 80423 - DNA, 20 bp, Homo sapiens
catggaggagccccgggccc

SEQ ID NO: 80424 - DNA, 19 bp, Homo sapiens
tggggagtgggggacccac

SEQ ID NO: 80425 - DNA, 15 bp, Homo sapiens
acatgggaggaccca

SEQ ID NO: 80426 - DNA, 18 bp, Homo sapiens
taacatggaaggtacacc

SEQ ID NO: 80427 - DNA, 20 bp, Homo sapiens
caggaggattgcgtgagccc

SEQ ID NO: 80428 - DNA, 20 bp, Homo sapiens
catgggggtcagggacccac

SEQ ID NO: 80429 - DNA, 20 bp, Homo sapiens
acagaaaattgaggattcac

SEQ ID NO: 80430 - DNA, 19 bp, Homo sapiens
acatggaagtagggcctac

SEQ ID NO: 80431 - DNA, 20 bp, Homo sapiens
acgtggacagacaggaccca

SEQ ID NO: 80432 - DNA, 17 bp, Homo sapiens
caacatgaatgaggacc

SEQ ID NO: 80433 - DNA, 21 bp, Homo sapiens
acttggaaactggggacccac

SEQ ID NO: 80434 - DNA, 18 bp, Homo sapiens
taacatgggaggtagaga

SEQ ID NO: 80435 - DNA, 21 bp, Homo sapiens
taacatggaagatacttaacc

SEQ ID NO: 80436 - DNA, 23 bp, Homo sapiens
taacatggggcaaccaggcccac

SEQ ID NO: 80437 - DNA, 15 bp, Homo sapiens
catggaagatgccca

SEQ ID NO: 80438 - DNA, 20 bp, Homo sapiens
atgggtagggggggacccac

SEQ ID NO: 80439 - DNA, 22 bp, Homo sapiens
taacatggtgacctgggcctac

SEQ ID NO: 80440 - DNA, 18 bp, Homo sapiens
tggggactcaggacccac

SEQ ID NO: 80441 - DNA, 17 bp, Homo sapiens
ggaggccttggacccac

SEQ ID NO: 80442 - DNA, 67 bp, Human herpesvirus 1
tgtccttactccgtcttggtgggtgggtggctgtgtatggcgtcccatctgtgcggggaggggggca

SEQ ID NO: 80443 - DNA, 24 bp, Human herpesvirus 1
cgtcccatctgtgcggggaggggg

SEQ ID NO: 80444 - DNA, 21 bp, Homo sapiens
cgtcttacgcatgggaggggg

SEQ ID NO: 80445 - DNA, 17 bp, Homo sapiens
gcccctgcggggagggg

SEQ ID NO: 80446 - DNA, 23 bp, Homo sapiens
cgttccatccgccccggaggggg

SEQ ID NO: 80447 - DNA, 21 bp, Homo sapiens
tcccttgctgtggggaggggg

SEQ ID NO: 80448 - DNA, 18 bp, Homo sapiens
gtccaggtggggaggggg

SEQ ID NO: 80449 - DNA, 22 bp, Homo sapiens
cgtccagaagctggggaggggg

SEQ ID NO: 80450 - DNA, 21 bp, Homo sapiens
gtccggcctttgggggggggg

SEQ ID NO: 80451 - DNA, 19 bp, Homo sapiens
tctgcctgcggggaggggg

SEQ ID NO: 80452 - DNA, 20 bp, Homo sapiens
gtcctcattgggggaggggg

SEQ ID NO: 80453 - DNA, 18 bp, Homo sapiens
tcatgcttggggaggggg

SEQ ID NO: 80454 - DNA, 21 bp, Homo sapiens
gcccagggcgtggggaggggg

SEQ ID NO: 80455 - DNA, 20 bp, Homo sapiens
gtgtcatcctggggaggggg

SEQ ID NO: 80456 - DNA, 20 bp, Homo sapiens
gtcttatttggcagaggggg

SEQ ID NO: 80457 - DNA, 19 bp, Homo sapiens
cctccctggcggggagggg

SEQ ID NO: 80458 - DNA, 22 bp, Homo sapiens
cattccacagtcggggaggggg

SEQ ID NO: 80459 - DNA, 19 bp, Homo sapiens
cgccccgtcgagggagggg

SEQ ID NO: 80460 - DNA, 24 bp, Homo sapiens
cgcctcgtctgtgcggcccctggg

SEQ ID NO: 80461 - DNA, 18 bp, Homo sapiens
cccgaggcggggaggggg

SEQ ID NO: 80462 - DNA, 18 bp, Homo sapiens
tccgggctggggaggggg

SEQ ID NO: 80463 - DNA, 22 bp, Homo sapiens
tcctggaggtgtggggaggggg

SEQ ID NO: 80464 - DNA, 20 bp, Homo sapiens
tctggggactggggaggggg

SEQ ID NO: 80465 - DNA, 20 bp, Homo sapiens
tctcatctgtgcgtcctggg

SEQ ID NO: 80466 - DNA, 26 bp, Homo sapiens
gtctcaacacgggggcggggaggggg

SEQ ID NO: 80467 - DNA, 23 bp, Homo sapiens
gtctcacgtttgtggggaggggg

SEQ ID NO: 80468 - DNA, 21 bp, Homo sapiens
ctccccaaagtggggaggggg

SEQ ID NO: 80469 - DNA, 15 bp, Homo sapiens
atctgtggaaggggg

SEQ ID NO: 80470 - DNA, 60 bp, Aleutian mink disease virus
ttaaagtaacctaacaccataacactttactttccttgtacttatgttactttactttag

SEQ ID NO: 80471 - DNA, 24 bp, Aleutian mink disease virus
aaagtaacctaacaccataacact

SEQ ID NO: 80472 - DNA, 19 bp, Homo sapiens
agtaacctaacatttccat

SEQ ID NO: 80473 - DNA, 21 bp, Homo sapiens
aaagtaacctaaatctgcaca

SEQ ID NO: 80474 - DNA, 21 bp, Homo sapiens
agttttcaacaccatagcact

SEQ ID NO: 80475 - DNA, 20 bp, Homo sapiens
aggaacctgacaccacacac

SEQ ID NO: 80476 - DNA, 21 bp, Homo sapiens
aaggaacctaacagccccact

SEQ ID NO: 80477 - DNA, 18 bp, Homo sapiens
aaagtaagttaacaccac

SEQ ID NO: 80478 - DNA, 18 bp, Homo sapiens
ggagtaatccagcaccat

SEQ ID NO: 80479 - DNA, 21 bp, Homo sapiens
aaataacctgcattcataaca

SEQ ID NO: 80480 - DNA, 22 bp, Homo sapiens
aaataactttagccataacact

SEQ ID NO: 80481 - DNA, 18 bp, Homo sapiens
agcttaacaccaaaaaca

SEQ ID NO: 80482 - DNA, 23 bp, Homo sapiens
aaagtaatttaaaccacaacact

SEQ ID NO: 80483 - DNA, 18 bp, Homo sapiens
aaagtgacccaacatcac

SEQ ID NO: 80484 - DNA, 19 bp, Homo sapiens
aaagtaactaactgccata

SEQ ID NO: 80485 - DNA, 16 bp, Homo sapiens
gtaacctaccatacac

SEQ ID NO: 80486 - DNA, 81 bp, Meleagrid herpesvirus 1
tgaccagtgaacaatttgtttaatgttagtttattcaatgcattggttgcaaatattcattacttctccaatcccaggtca

SEQ ID NO: 80487 - DNA, 24 bp, Meleagrid herpesvirus 1
ttggttgcaaatattcattacttc

SEQ ID NO: 80488 - DNA, 21 bp, Homo sapiens
ttggttgcagctatctccttc

SEQ ID NO: 80489 - DNA, 21 bp, Homo sapiens
tggttgcagatcgtttacttc

SEQ ID NO: 80490 - DNA, 22 bp, Homo sapiens
ttggttgttaattcattatttc

SEQ ID NO: 80491 - DNA, 22 bp, Homo sapiens
ttggctgcataaacattatttc

SEQ ID NO: 80492 - DNA, 20 bp, Homo sapiens
ttggttgcaccatgttactt

SEQ ID NO: 80493 - DNA, 16 bp, Homo sapiens
ttgcttgcaaattact

SEQ ID NO: 80494 - DNA, 90 bp, Banana mild mosaic virus
gaagttaatggaaatagggcgtttgttaggggttgtgaaataaacgaacaactggcttcagtgattagagagctcaaaccagttaagttc

SEQ ID NO: 80495 - DNA, 24 bp, Banana mild mosaic virus
ttaatggaaatagggcgtttgtta

SEQ ID NO: 80496 - DNA, 18 bp, Homo sapiens
ttaatggaagtgggttta

SEQ ID NO: 80497 - DNA, 22 bp, Homo sapiens
ttaatgaaggtggcacaatgtt

SEQ ID NO: 80498 - DNA, 21 bp, Homo sapiens
ttagtagagatggggtgtttg

SEQ ID NO: 80499 - DNA, 18 bp, Homo sapiens
tcaatggaaatagatgtt

SEQ ID NO: 80500 - DNA, 18 bp, Homo sapiens
ttaatagagatggggttt

SEQ ID NO: 80501 - DNA, 21 bp, Homo sapiens
ttaatggaggtagggttttta

SEQ ID NO: 80502 - DNA, 21 bp, Homo sapiens
ttaatggaagtgggccgcagt

SEQ ID NO: 80503 - DNA, 16 bp, Homo sapiens
ttaatggaagggtgtt

SEQ ID NO: 80504 - DNA, 122 bp, Porcine adenovirus C
gatctttcccacgttgtatgccatcttccagcagagccgcggagtagacagcaacctcaaggttaaaaacagatcacttcgctctctcaccaaaagctgcttgtatcacaaccaggaatctc

SEQ ID NO: 80505 - DNA, 24 bp, Porcine adenovirus C
tctttcccacgttgtatgccatct

SEQ ID NO: 80506 - DNA, 22 bp, Homo sapiens
ctttcccatgtaccagctgtct

SEQ ID NO: 80507 - DNA, 24 bp, Homo sapiens
tcttttataatcagtatgccatct

SEQ ID NO: 80508 - DNA, 21 bp, Homo sapiens
ttccccactcagttgtcatct

SEQ ID NO: 80509 - DNA, 23 bp, Homo sapiens
tcttttcaaagcacatgccatct

SEQ ID NO: 80510 - DNA, 19 bp, Homo sapiens
tcttccccgcgtctcctct

SEQ ID NO: 80511 - DNA, 21 bp, Homo sapiens
tctctcctgtatctgccatct

SEQ ID NO: 80512 - DNA, 19 bp, Homo sapiens
tttcccactgtcttcatct

SEQ ID NO: 80513 - DNA, 23 bp, Homo sapiens
tctgtcccacacacctgccatct

SEQ ID NO: 80514 - DNA, 22 bp, Homo sapiens
tctttcccatttctctacatct

SEQ ID NO: 80515 - DNA, 25 bp, Homo sapiens
tctttcccacttgtgagacaaatct

SEQ ID NO: 80516 - DNA, 19 bp, Homo sapiens
tctctcccatgttcctatc

SEQ ID NO: 80517 - DNA, 19 bp, Homo sapiens
tccttcccgtgttggagcc

SEQ ID NO: 80518 - DNA, 18 bp, Homo sapiens
tctttcccatggttgtat

SEQ ID NO: 80519 - DNA, 20 bp, Homo sapiens
tttcagacgtcctgccatct

SEQ ID NO: 80520 - DNA, 17 bp, Homo sapiens
tctttttcacgttatgc

SEQ ID NO: 80521 - DNA, 18 bp, Homo sapiens
tcttttcctgctgtcatc

SEQ ID NO: 80522 - DNA, 19 bp, Homo sapiens
tcttttcctagatgccatc

SEQ ID NO: 80523 - DNA, 19 bp, Homo sapiens
tctttcccactgtggttgt

SEQ ID NO: 80524 - DNA, 18 bp, Homo sapiens
ctttccacgtgtgccatc

SEQ ID NO: 80525 - DNA, 22 bp, Homo sapiens
tctttcccttcagatgttatct

SEQ ID NO: 80526 - DNA, 23 bp, Homo sapiens
tctttcccctgtgtgagttatct

SEQ ID NO: 80527 - DNA, 15 bp, Homo sapiens
tctttcccagttcat

SEQ ID NO: 80528 - DNA, 18 bp, Homo sapiens
tctttccaccatgccatc

SEQ ID NO: 80529 - DNA, 16 bp, Homo sapiens
ctttcccatatgccat

SEQ ID NO: 80530 - DNA, 18 bp, Homo sapiens
tctctcctgtctgccatc

SEQ ID NO: 80531 - DNA, 19 bp, Homo sapiens
tctttccagtctatgccat

SEQ ID NO: 80532 - DNA, 67 bp, African swine fever virus
ggtatgacgtgaaaaaatagattaggtaggttgtgaaaaacagattaaacttaaaattatgtgtatt

SEQ ID NO: 80533 - DNA, 24 bp, African swine fever virus
tgacgtgaaaaaatagattaggta

SEQ ID NO: 80534 - DNA, 21 bp, Homo sapiens
tgacatgaggggaaaaaggta

SEQ ID NO: 80535 - DNA, 17 bp, Homo sapiens
tgactgagaaaatagac

SEQ ID NO: 80536 - DNA, 21 bp, Homo sapiens
tgattgaaaaagcactaggta

SEQ ID NO: 80537 - DNA, 63 bp, Chimpanzee cytomegalovirus
gatcgtctttttggctgtgaagtccctcaataaatactagtgaactcattgcctccggctgtc

SEQ ID NO: 80538 - DNA, 23 bp, Chimpanzee cytomegalovirus
tgaactcattgcctccggctgtc

SEQ ID NO: 80539 - DNA, 20 bp, Homo sapiens
tgaggtcactgccggttgtc

SEQ ID NO: 80540 - DNA, 18 bp, Homo sapiens
tggactcactgctgctgt

SEQ ID NO: 80541 - DNA, 18 bp, Homo sapiens
gaattcattgcctttact

SEQ ID NO: 80542 - DNA, 18 bp, Homo sapiens
tgtactcattgccagtgt

SEQ ID NO: 80543 - DNA, 19 bp, Homo sapiens
tcactgcccagtacttgtc

SEQ ID NO: 80544 - DNA, 29 bp, Homo sapiens
tgggctccagctgcagcctctggctgtcg

SEQ ID NO: 80545 - DNA, 21 bp, Homo sapiens
tgaactcatgtccaaaatgtc

SEQ ID NO: 80546 - DNA, 21 bp, Homo sapiens
tgggctcactgcttcctggct

SEQ ID NO: 80547 - DNA, 18 bp, Homo sapiens
tgaactcatggcttctga

SEQ ID NO: 80548 - DNA, 21 bp, Homo sapiens
actgcctctccttcggctgtc

SEQ ID NO: 80549 - DNA, 17 bp, Homo sapiens
tgaactcatgaagctgt

SEQ ID NO: 80550 - DNA, 17 bp, Homo sapiens
tgacttattgcctctgc

SEQ ID NO: 80551 - DNA, 20 bp, Homo sapiens
tggactccagccctggctgt

SEQ ID NO: 80552 - DNA, 18 bp, Homo sapiens
tcagcaggcccggctgtc

SEQ ID NO: 80553 - DNA, 20 bp, Homo sapiens
tggactcattagtctctgct

SEQ ID NO: 80554 - DNA, 20 bp, Homo sapiens
gaactcattgctgccctgtc

SEQ ID NO: 80555 - DNA, 87 bp, Fowl adenovirus A
gtcgtacacccggctgacgagaaacacgcttcgggggtggaccagggctggttcttcccgaacgaggacatagtcagcggtgatgac

SEQ ID NO: 80556 - DNA, 24 bp, Fowl adenovirus A
ttcccgaacgaggacatagtcagc

SEQ ID NO: 80557 - DNA, 18 bp, Homo sapiens
ttcccaagtgacagtcag

SEQ ID NO: 80558 - DNA, 23 bp, Homo sapiens
ctcctgggcgaggacacgtcggc

SEQ ID NO: 80559 - DNA, 22 bp, Homo sapiens
ttcctgcacgaggacatgaagc

SEQ ID NO: 80560 - DNA, 22 bp, Homo sapiens
ttcctggatggtgataatcagc

SEQ ID NO: 80561 - DNA, 21 bp, Homo sapiens
ttcccgaagtgagggtgtgtc

SEQ ID NO: 80562 - DNA, 18 bp, Homo sapiens
ttctccaacgaggagaca

SEQ ID NO: 80563 - DNA, 18 bp, Homo sapiens
ttcccgaacgggagtagc

SEQ ID NO: 80564 - DNA, 21 bp, Homo sapiens
ctccggatgaggacacccagc

SEQ ID NO: 80565 - DNA, 130 bp, Cowpox virus
attcaacttgttaaattaataatggatagtttaaaatagttattagtagtaataagatagtttaaaatagttattagtagtaataagatagtttaaaatagttattagtagtaataagatagtttaaaat

SEQ ID NO: 80566 - DNA, 24 bp, Cowpox virus
ttagtagtaataagatagtttaaa

SEQ ID NO: 80567 - DNA, 18 bp, Homo sapiens
ttagcagtggtgacagtt

SEQ ID NO: 80568 - DNA, 18 bp, Homo sapiens
tagtagtgataagagttt

SEQ ID NO: 80569 - DNA, 21 bp, Homo sapiens
tagtagtaaaacaggtttaaa

SEQ ID NO: 80570 - DNA, 19 bp, Homo sapiens
agtcaataagatagtttaa

SEQ ID NO: 80571 - DNA, 18 bp, Homo sapiens
gtgaccagatagtttaaa

SEQ ID NO: 80572 - DNA, 21 bp, Homo sapiens
ttagcagcatcagatggttta

SEQ ID NO: 80573 - DNA, 18 bp, Homo sapiens
tagtactaaatagtttaa

SEQ ID NO: 80574 - DNA, 81 bp, Molluscum contagiosum virus
gggccaacgttccgtcgtgtgcttgcggctcagtccagtttcgcgtttgcaggccagtgcgacgttgcgtgcttgtggccc

SEQ ID NO: 80575 - DNA, 24 bp, Molluscum contagiosum virus
tttgcaggccagtgcgacgttgcg

SEQ ID NO: 80576 - DNA, 21 bp, Homo sapiens
tttgcagggctggtgttggcg

SEQ ID NO: 80577 - DNA, 27 bp, Homo sapiens
tttgcaggccaggtgggcgcaacgtcg

SEQ ID NO: 80578 - DNA, 122 bp, Monkeypox virus
attgtatattttattttattttatattttatattttatattttattttatattttgtagtaagaatagaatgctaaatgtcaagtttattcgaatagatgtcttattaaaaacatatataat

SEQ ID NO: 80579 - DNA, 24 bp, Monkeypox virus
tattttattttattttatatttta

SEQ ID NO: 80580 - DNA, 24 bp, Homo sapiens
attttatttcatacatatatttta

SEQ ID NO: 80581 - DNA, 19 bp, Homo sapiens
tatttcattttattttata

SEQ ID NO: 80582 - DNA, 22 bp, Homo sapiens
ttttaagttattttatatttta

SEQ ID NO: 80583 - DNA, 18 bp, Homo sapiens
tattttattttattttat

SEQ ID NO: 80584 - DNA, 23 bp, Homo sapiens
tattttattttattttatttttt

SEQ ID NO: 80585 - DNA, 19 bp, Homo sapiens
ttttattttattttacatt

SEQ ID NO: 80586 - DNA, 24 bp, Homo sapiens
tattttattttatttatttatttt

SEQ ID NO: 80587 - DNA, 18 bp, Homo sapiens
cattttattttattttat

SEQ ID NO: 80588 - DNA, 18 bp, Homo sapiens
tatttcattttattttat

SEQ ID NO: 80589 - DNA, 22 bp, Homo sapiens
cattttattttaaacatatttt

SEQ ID NO: 80590 - DNA, 18 bp, Homo sapiens
tattttattttatcttat

SEQ ID NO: 80591 - DNA, 18 bp, Homo sapiens
attttattttattttata

SEQ ID NO: 80592 - DNA, 74 bp, Banna virus
tgctactaggatgtaagatttagatcggaaggacgtcccacacccttccactatattcttcatcccgaatagca

SEQ ID NO: 80593 - DNA, 24 bp, Banna virus
aggatgtaagatttagatcggaag

SEQ ID NO: 80594 - DNA, 19 bp, Homo sapiens
ggatgtaagagttggccag

SEQ ID NO: 80595 - DNA, 20 bp, Homo sapiens
agggttaagatttgaatcga

SEQ ID NO: 80596 - DNA, 18 bp, Homo sapiens
aggatgtaagctcccgga

SEQ ID NO: 80597 - DNA, 20 bp, Homo sapiens
aggtgtaagatttaaaacaa

SEQ ID NO: 80598 - DNA, 19 bp, Homo sapiens
ggatataaggtacatggga

SEQ ID NO: 80599 - DNA, 22 bp, Homo sapiens
ggatgcaagatgcacgtggaag

SEQ ID NO: 80600 - DNA, 18 bp, Homo sapiens
aagatgtaagatttacag

SEQ ID NO: 80601 - DNA, 21 bp, Homo sapiens
aggaggtaagattaatggaag

SEQ ID NO: 80602 - DNA, 24 bp, Homo sapiens
ggcatgtgagatttacatcagaag

SEQ ID NO: 80603 - DNA, 71 bp, Sulfolobus virus SIRV-2
gaataggtcagaagtaataagacttgcaatagagaaattagtagtagatgaaatgaaaaatgaaccagttc

SEQ ID NO: 80604 - DNA, 24 bp, Sulfolobus virus SIRV-2
taggtcagaagtaataagacttgc

SEQ ID NO: 80605 - DNA, 20 bp, Homo sapiens
aggtatctagtgagacttgc

SEQ ID NO: 80606 - DNA, 16 bp, Homo sapiens
tagatcaggaggactt

SEQ ID NO: 80607 - DNA, 20 bp, Homo sapiens
caggtcaggagctcgacttg

SEQ ID NO: 80608 - DNA, 18 bp, Homo sapiens
taagtcagaagttacttg

SEQ ID NO: 80609 - DNA, 20 bp, Homo sapiens
ggtcagaagtaatcccttgc

SEQ ID NO: 80610 - DNA, 15 bp, Homo sapiens
gtccaataagacttg

SEQ ID NO: 80611 - DNA, 17 bp, Homo sapiens
aggtcagaagtaatgac

SEQ ID NO: 80612 - DNA, 23 bp, Homo sapiens
taggtcagaagtgattaaacagc

SEQ ID NO: 80613 - DNA, 19 bp, Homo sapiens
taggtcaggggtcgatctg

SEQ ID NO: 80614 - DNA, 114 bp, Tupaia herpesvirus
gtcgaggaacacgcccccggaccccgtataaggccggcgggcgcctcggacttcttcttttttggcgaggaacacgcccccggaccccgtataaggccggcgggtgcctcggac

SEQ ID NO: 80615 - DNA, 24 bp, Tupaia herpesvirus
aggccggcgggcgcctcggacttc

SEQ ID NO: 80616 - DNA, 24 bp, Homo sapiens
ggccggcgggcgcccccggccttc

SEQ ID NO: 80617 - DNA, 18 bp, Homo sapiens
aggcggtgggcgcggctt

SEQ ID NO: 80618 - DNA, 26 bp, Homo sapiens
aggccggtctcaaactcttggacttc

SEQ ID NO: 80619 - DNA, 22 bp, Homo sapiens
ggcggtgggcggcggcggcttc

SEQ ID NO: 80620 - DNA, 18 bp, Homo sapiens
aggtcggcgggcaccacg

SEQ ID NO: 80621 - DNA, 23 bp, Homo sapiens
aggcggcgggcgccggcgtcttc

SEQ ID NO: 80622 - DNA, 16 bp, Homo sapiens
aggcaggcgggggact

SEQ ID NO: 80623 - DNA, 20 bp, Homo sapiens
ggccgcgggcgcgccggctt

SEQ ID NO: 80624 - DNA, 19 bp, Homo sapiens
aggctggcgggcgccgcgg

SEQ ID NO: 80625 - DNA, 23 bp, Homo sapiens
ggcttggacacccctcgggcttc

SEQ ID NO: 80626 - DNA, 16 bp, Homo sapiens
ggccggcgggcctggg

SEQ ID NO: 80627 - DNA, 21 bp, Homo sapiens
aggccggctgggtgtggcttc

SEQ ID NO: 80628 - DNA, 22 bp, Homo sapiens
agggttccagcgcctcggactt

SEQ ID NO: 80629 - DNA, 23 bp, Homo sapiens
aggccagactcactttgggcttc

SEQ ID NO: 80630 - DNA, 25 bp, Homo sapiens
aggccggcgggtccctgctggactt

SEQ ID NO: 80631 - DNA, 18 bp, Homo sapiens
aggtcggcgagcgcctcg

SEQ ID NO: 80632 - DNA, 64 bp, Molluscum contagiosum virus
gctggcacggccggcgccgcgcaagatgacgacgggagaggttgcgcggggcaggcagtgccgc

SEQ ID NO: 80633 - DNA, 21 bp, Molluscum contagiosum virus
gcgcggggcaggcagtgccgc

SEQ ID NO: 80634 - DNA, 21 bp, Homo sapiens
gcgtgggagtgcagaggctgc

SEQ ID NO: 80635 - DNA, 20 bp, Homo sapiens
gcctggggcagaccacctgc

SEQ ID NO: 80636 - DNA, 18 bp, Homo sapiens
gcgcggaggcgggagcgc

SEQ ID NO: 80637 - DNA, 22 bp, Homo sapiens
gcgcggggacgggcgggaccgc

SEQ ID NO: 80638 - DNA, 19 bp, Homo sapiens
gcgcgggggggcagggggc

SEQ ID NO: 80639 - DNA, 15 bp, Homo sapiens
gcgcggggcacgccg

SEQ ID NO: 80640 - DNA, 17 bp, Homo sapiens
gcatggggcaggtccac

SEQ ID NO: 80641 - DNA, 16 bp, Homo sapiens
gcgcggggcgagtccg

SEQ ID NO: 80642 - DNA, 19 bp, Homo sapiens
gcatggggcaggcgctcgc

SEQ ID NO: 80643 - DNA, 20 bp, Homo sapiens
gcgcggaggcgcagagccgc

SEQ ID NO: 80644 - DNA, 19 bp, Homo sapiens
gcgcagggtaggtagctgc

SEQ ID NO: 80645 - DNA, 17 bp, Homo sapiens
gcagggcagaggtgcca

SEQ ID NO: 80646 - DNA, 16 bp, Homo sapiens
gcgcggggcggggcgc

SEQ ID NO: 80647 - DNA, 15 bp, Homo sapiens
gcgcggggcgcgcca

SEQ ID NO: 80648 - DNA, 19 bp, Homo sapiens
gcatggggcaggaagacgc

SEQ ID NO: 80649 - DNA, 18 bp, Homo sapiens
gcgcagggcaagcgctgc

SEQ ID NO: 80650 - DNA, 19 bp, Homo sapiens
gcgcggggcgtcgcgccgc

SEQ ID NO: 80651 - DNA, 18 bp, Homo sapiens
gcgcggggctgggggcgc

SEQ ID NO: 80652 - DNA, 19 bp, Homo sapiens
gcgggggcaggtccagagc

SEQ ID NO: 80653 - DNA, 21 bp, Homo sapiens
gctggggcaggtggatgctgc

SEQ ID NO: 80654 - DNA, 18 bp, Homo sapiens
gcgcgggggcggtggccg

SEQ ID NO: 80655 - DNA, 20 bp, Homo sapiens
gcgcggggctggggggctgc

SEQ ID NO: 80656 - DNA, 17 bp, Homo sapiens
cgcggggcgagggccgc

SEQ ID NO: 80657 - DNA, 17 bp, Homo sapiens
gcagcaggcagtgctgc

SEQ ID NO: 80658 - DNA, 19 bp, Homo sapiens
gcgtggggcagggtgaggc

SEQ ID NO: 80659 - DNA, 15 bp, Homo sapiens
gcacggggcgggtgc

SEQ ID NO: 80660 - DNA, 17 bp, Homo sapiens
gccggggcagccaccgc

SEQ ID NO: 80661 - DNA, 21 bp, Homo sapiens
gcgcggggcgcggggtgctgc

SEQ ID NO: 80662 - DNA, 18 bp, Homo sapiens
gcgcggggaatccgccgc

SEQ ID NO: 80663 - DNA, 18 bp, Homo sapiens
gcgcggagccactgccgc

SEQ ID NO: 80664 - DNA, 19 bp, Homo sapiens
gctgcggggcggcagccgc

SEQ ID NO: 80665 - DNA, 20 bp, Homo sapiens
gcgcggggccggagcgccgc

SEQ ID NO: 80666 - DNA, 19 bp, Homo sapiens
gccgggggggcggtgctgc

SEQ ID NO: 80667 - DNA, 22 bp, Homo sapiens
gcgctggggtggggggcgccgc

SEQ ID NO: 80668 - DNA, 17 bp, Homo sapiens
gccggggcagagcctgc

SEQ ID NO: 80669 - DNA, 22 bp, Homo sapiens
gcgcggggagggctctggccgc

SEQ ID NO: 80670 - DNA, 19 bp, Homo sapiens
gcggggcaggactcgctgc

SEQ ID NO: 80671 - DNA, 20 bp, Homo sapiens
gccggggcaggactcaccgc

SEQ ID NO: 80672 - DNA, 19 bp, Homo sapiens
gcgcggggctggtccccgc

SEQ ID NO: 80673 - DNA, 18 bp, Homo sapiens
gctgggcagtgcccaccg

SEQ ID NO: 80674 - DNA, 17 bp, Homo sapiens
gcgcggggagggggcgc

SEQ ID NO: 80675 - DNA, 19 bp, Homo sapiens
cgcggggcgctgcggtcgc

SEQ ID NO: 80676 - DNA, 19 bp, Homo sapiens
gcgcgaggcgggcagccgc

SEQ ID NO: 80677 - DNA, 15 bp, Homo sapiens
gcgcggggaggtgcg

SEQ ID NO: 80678 - DNA, 16 bp, Homo sapiens
gcgcgggggcagctcg

SEQ ID NO: 80679 - DNA, 16 bp, Homo sapiens
gcgcggggaggggcgc

SEQ ID NO: 80680 - DNA, 17 bp, Homo sapiens
gcggggggcaggggcgc

SEQ ID NO: 80681 - DNA, 18 bp, Homo sapiens
gcgcagagtcagtgccgc

SEQ ID NO: 80682 - DNA, 16 bp, Homo sapiens
gcgaggggcaggatgc

SEQ ID NO: 80683 - DNA, 16 bp, Homo sapiens
gcgcggggctgccagc

SEQ ID NO: 80684 - DNA, 16 bp, Homo sapiens
gcgcggggacagcccg

SEQ ID NO: 80685 - DNA, 24 bp, Homo sapiens
gcgcgggagcagagggcatgctgc

SEQ ID NO: 80686 - DNA, 19 bp, Homo sapiens
gcgcggaggtggaactcgc

SEQ ID NO: 80687 - DNA, 18 bp, Homo sapiens
gcgcggcggcgccgccgc

SEQ ID NO: 80688 - DNA, 18 bp, Homo sapiens
gcggggcggccaggccgc

SEQ ID NO: 80689 - DNA, 20 bp, Homo sapiens
gcgcggggctggccggctgc

SEQ ID NO: 80690 - DNA, 18 bp, Homo sapiens
gcggggcaggggacctgc

SEQ ID NO: 80691 - DNA, 20 bp, Homo sapiens
gcgcggggtcacgtagttgc

SEQ ID NO: 80692 - DNA, 16 bp, Homo sapiens
gcggggcgggcgcccg

SEQ ID NO: 80693 - DNA, 19 bp, Homo sapiens
gcgcggcggcggggctacc

SEQ ID NO: 80694 - DNA, 20 bp, Homo sapiens
gcgcagggcgggaaggctgc

SEQ ID NO: 80695 - DNA, 20 bp, Homo sapiens
gcgcggggggcacgggctgc

SEQ ID NO: 80696 - DNA, 19 bp, Homo sapiens
gcgcggagcgggtggctgc

SEQ ID NO: 80697 - DNA, 21 bp, Homo sapiens
gcgcggggcaggccggaagcg

SEQ ID NO: 80698 - DNA, 15 bp, Homo sapiens
gccggggcaagctgc

SEQ ID NO: 80699 - DNA, 22 bp, Homo sapiens
gcgcggggctggatggggctgc

SEQ ID NO: 80700 - DNA, 21 bp, Homo sapiens
gcacggggaagttagtgttgc

SEQ ID NO: 80701 - DNA, 19 bp, Homo sapiens
gcgcgggggtaggctttgc

SEQ ID NO: 80702 - DNA, 18 bp, Homo sapiens
gccggggcggggcgctgc

SEQ ID NO: 80703 - DNA, 18 bp, Homo sapiens
gcgggccaggcaggctgc

SEQ ID NO: 80704 - DNA, 18 bp, Homo sapiens
gcgcggggcgtggggcgc

SEQ ID NO: 80705 - DNA, 18 bp, Homo sapiens
gcgtggggcgcgagctgc

SEQ ID NO: 80706 - DNA, 18 bp, Homo sapiens
gcgcggggcacccgccgc

SEQ ID NO: 80707 - DNA, 15 bp, Homo sapiens
cgagggcagtgccgc

SEQ ID NO: 80708 - DNA, 19 bp, Homo sapiens
gctcggggcaggctgaggc

SEQ ID NO: 80709 - DNA, 17 bp, Homo sapiens
gcgcggggaggcggcgc

SEQ ID NO: 80710 - DNA, 19 bp, Homo sapiens
gcgtggggcagagacctgc

SEQ ID NO: 80711 - DNA, 17 bp, Homo sapiens
acgcgggggcggtgccg

SEQ ID NO: 80712 - DNA, 18 bp, Homo sapiens
gcgcggggcgcggggcgc

SEQ ID NO: 80713 - DNA, 21 bp, Homo sapiens
gctgggaaagggcggtgctgc

SEQ ID NO: 80714 - DNA, 17 bp, Homo sapiens
gcgcgggacaggctggc

SEQ ID NO: 80715 - DNA, 24 bp, Homo sapiens
gcgcggggcagggcccggggccgc

SEQ ID NO: 80716 - DNA, 22 bp, Homo sapiens
gctggggcaggggtcacgtcgc

SEQ ID NO: 80717 - DNA, 17 bp, Homo sapiens
acgcggggcggagctgc

SEQ ID NO: 80718 - DNA, 18 bp, Homo sapiens
gcccggggcagcggctgc

SEQ ID NO: 80719 - DNA, 16 bp, Homo sapiens
gcgggggcgctgctgc

SEQ ID NO: 80720 - DNA, 19 bp, Homo sapiens
cactgatgggcagtgctgc

SEQ ID NO: 80721 - DNA, 15 bp, Homo sapiens
gcgcgaggcggctgc

SEQ ID NO: 80722 - DNA, 18 bp, Homo sapiens
gcgcgggggggcggctgc

SEQ ID NO: 80723 - DNA, 16 bp, Homo sapiens
cgcggggcagcgccgc

SEQ ID NO: 80724 - DNA, 19 bp, Homo sapiens
gcgcgggggtaggcattgc

SEQ ID NO: 80725 - DNA, 20 bp, Homo sapiens
gcacggggtagggaagttgc

SEQ ID NO: 80726 - DNA, 19 bp, Homo sapiens
acgcggggtgggtgggggc

SEQ ID NO: 80727 - DNA, 20 bp, Homo sapiens
gcgcgggatgagtgtgctgc

SEQ ID NO: 80728 - DNA, 18 bp, Homo sapiens
gcgcggggcggggcgagc

SEQ ID NO: 80729 - DNA, 16 bp, Homo sapiens
gcgcggggctggcccg

SEQ ID NO: 80730 - DNA, 16 bp, Homo sapiens
gcgcggggcggggccg

SEQ ID NO: 80731 - DNA, 19 bp, Homo sapiens
gcgcggggcggccggacgc

SEQ ID NO: 80732 - DNA, 18 bp, Homo sapiens
gctaaaagcgggcagtgc

SEQ ID NO: 80733 - DNA, 20 bp, Homo sapiens
cgtggggcagggcgcgccgc

SEQ ID NO: 80734 - DNA, 21 bp, Homo sapiens
gctcaaaccgggcagtgccgc

SEQ ID NO: 80735 - DNA, 18 bp, Homo sapiens
acgcggggcgggccctgc

SEQ ID NO: 80736 - DNA, 21 bp, Homo sapiens
gcgcgggggagcggacgctgc

SEQ ID NO: 80737 - DNA, 22 bp, Homo sapiens
gcgcgagggcgggtcaggctgc

SEQ ID NO: 80738 - DNA, 22 bp, Homo sapiens
gcgcggggcgcggggcgactgc

SEQ ID NO: 80739 - DNA, 23 bp, Homo sapiens
gcgcggggtgtgggcggtgccgc

SEQ ID NO: 80740 - DNA, 17 bp, Homo sapiens
gcgcggggcggcggcgc

SEQ ID NO: 80741 - DNA, 18 bp, Homo sapiens
gcgcggcggcagcgctgc

SEQ ID NO: 80742 - DNA, 16 bp, Homo sapiens
acggaaggcagtgccg

SEQ ID NO: 80743 - DNA, 18 bp, Homo sapiens
gcgcaggggtggctgacg

SEQ ID NO: 80744 - DNA, 18 bp, Homo sapiens
gcgcggagcagggatcgc

SEQ ID NO: 80745 - DNA, 19 bp, Homo sapiens
gcgcaggagaaggtgccgc

SEQ ID NO: 80746 - DNA, 18 bp, Homo sapiens
cgcggggcggggcggcgc

SEQ ID NO: 80747 - DNA, 16 bp, Homo sapiens
gcgtgggacaggaggc

SEQ ID NO: 80748 - DNA, 20 bp, Homo sapiens
acgcggggcaggccgggagc

SEQ ID NO: 80749 - DNA, 20 bp, Homo sapiens
gcgctgggaggcagtgctgc

SEQ ID NO: 80750 - DNA, 16 bp, Homo sapiens
cggggcagcgcgctgc

SEQ ID NO: 80751 - DNA, 28 bp, Homo sapiens
gcgcgggggctgctggggcggtgccgcg

SEQ ID NO: 80752 - DNA, 17 bp, Homo sapiens
gcgcggggaggagttgc

SEQ ID NO: 80753 - DNA, 21 bp, Homo sapiens
gctggggcagggtggcgccgc

SEQ ID NO: 80754 - DNA, 19 bp, Homo sapiens
gctggggcaggaacactgc

SEQ ID NO: 80755 - DNA, 21 bp, Homo sapiens
gcgtggggctgcccgggccgc

SEQ ID NO: 80756 - DNA, 18 bp, Homo sapiens
gctggggcagagaactgc

SEQ ID NO: 80757 - DNA, 16 bp, Homo sapiens
gcaggacaggtgctgc

SEQ ID NO: 80758 - DNA, 19 bp, Homo sapiens
gcgggggcaggcgagaggc

SEQ ID NO: 80759 - DNA, 17 bp, Homo sapiens
gcgcagggcagcctcgc

SEQ ID NO: 80760 - DNA, 17 bp, Homo sapiens
gcgcggggctgagctgc

SEQ ID NO: 80761 - DNA, 18 bp, Homo sapiens
gcgctgggtaaacgccgc

SEQ ID NO: 80762 - DNA, 20 bp, Homo sapiens
gcgcggggggcaggtgctgc

SEQ ID NO: 80763 - DNA, 17 bp, Homo sapiens
gcgcggggccgagctgc

SEQ ID NO: 80764 - DNA, 20 bp, Homo sapiens
gcgtggggcaagagttttgc

SEQ ID NO: 80765 - DNA, 17 bp, Homo sapiens
gcgcaggggtggaggcc

SEQ ID NO: 80766 - DNA, 26 bp, Homo sapiens
gcggggcagggtccctcagtgctgcg

SEQ ID NO: 80767 - DNA, 16 bp, Homo sapiens
acgcggggcagggcgc

SEQ ID NO: 80768 - DNA, 17 bp, Homo sapiens
gcacggggtgggcaggc

SEQ ID NO: 80769 - DNA, 21 bp, Homo sapiens
gcgcggggaggctaggctcgc

SEQ ID NO: 80770 - DNA, 19 bp, Homo sapiens
acgcggggcgcgaggctgc

SEQ ID NO: 80771 - DNA, 18 bp, Homo sapiens
gctggagtgcagtgccgc

SEQ ID NO: 80772 - DNA, 16 bp, Homo sapiens
gccggggcaggcacgc

SEQ ID NO: 80773 - DNA, 20 bp, Homo sapiens
gcctggggcaggtctcaggc

SEQ ID NO: 80774 - DNA, 19 bp, Homo sapiens
gcgcgggacggtccgccgc

SEQ ID NO: 80775 - DNA, 16 bp, Homo sapiens
gcgcgggcaggcaggc

SEQ ID NO: 80776 - DNA, 18 bp, Homo sapiens
acgcggggactgtgctgc

SEQ ID NO: 80777 - DNA, 17 bp, Homo sapiens
gcgtggtggcaggtgcc

SEQ ID NO: 80778 - DNA, 17 bp, Homo sapiens
gccggggcaggggacgc

SEQ ID NO: 80779 - DNA, 19 bp, Homo sapiens
gcgctgggctgcctgctgc

SEQ ID NO: 80780 - DNA, 16 bp, Homo sapiens
gcgcgagggcggctgc

SEQ ID NO: 80781 - DNA, 22 bp, Homo sapiens
gcgcaggggcaggcaggactcg

SEQ ID NO: 80782 - DNA, 18 bp, Homo sapiens
gcgcaggcgcagtgccgc

SEQ ID NO: 80783 - DNA, 15 bp, Homo sapiens
gcgggggcagactgc

SEQ ID NO: 80784 - DNA, 20 bp, Homo sapiens
gcgcggggcatgcaggctgc

SEQ ID NO: 80785 - DNA, 17 bp, Homo sapiens
gcgcggggctgggctgc

SEQ ID NO: 80786 - DNA, 20 bp, Homo sapiens
gcgcggggcgcacgggctgc

SEQ ID NO: 80787 - DNA, 15 bp, Homo sapiens
gcgcggggcaggtgc

SEQ ID NO: 80788 - DNA, 23 bp, Homo sapiens
gcgtggggcaaggcctcaagtgc

SEQ ID NO: 80789 - DNA, 20 bp, Homo sapiens
gcgcggggctggagagccgc

SEQ ID NO: 80790 - DNA, 17 bp, Homo sapiens
gctggggcaggagctgc

SEQ ID NO: 80791 - DNA, 18 bp, Homo sapiens
gcgcggggctgcggctgc

SEQ ID NO: 80792 - DNA, 17 bp, Homo sapiens
gccgagggcagtgctgc

SEQ ID NO: 80793 - DNA, 18 bp, Homo sapiens
gcgcggggctgcctccgc

SEQ ID NO: 80794 - DNA, 19 bp, Homo sapiens
gcgcgggacggctctccgc

SEQ ID NO: 80795 - DNA, 26 bp, Homo sapiens
acggggtgtgggtgggcggtgccgcg

SEQ ID NO: 80796 - DNA, 25 bp, Homo sapiens
gcgcggggtgaggtccgggggccgc

SEQ ID NO: 80797 - DNA, 15 bp, Homo sapiens
gcgcggggcgcgcgc

SEQ ID NO: 80798 - DNA, 15 bp, Homo sapiens
gcgcggggcggctgc

SEQ ID NO: 80799 - DNA, 18 bp, Homo sapiens
gccgggtgggcagtgccg

SEQ ID NO: 80800 - DNA, 18 bp, Homo sapiens
gcgcggggcgcgtggtgc

SEQ ID NO: 80801 - DNA, 16 bp, Homo sapiens
gcgggggcacagctgc

SEQ ID NO: 80802 - DNA, 23 bp, Homo sapiens
gcgcggggcgggctcggggctgc

SEQ ID NO: 80803 - DNA, 19 bp, Homo sapiens
gcgcggggcgagggcgccg

SEQ ID NO: 80804 - DNA, 18 bp, Homo sapiens
gcgcggggaagaacctgc

SEQ ID NO: 80805 - DNA, 19 bp, Homo sapiens
gcgggggcaggtctgaggc

SEQ ID NO: 80806 - DNA, 19 bp, Homo sapiens
gcgtgggcagcacctccgc

SEQ ID NO: 80807 - DNA, 21 bp, Homo sapiens
gcgcggggcggccagtcccgc

SEQ ID NO: 80808 - DNA, 21 bp, Homo sapiens
gcgcggggtgggcggtggggc

SEQ ID NO: 80809 - DNA, 20 bp, Homo sapiens
gcgcggagcgggactggcgc

SEQ ID NO: 80810 - DNA, 18 bp, Homo sapiens
gcgcggggcgcgggctgc

SEQ ID NO: 80811 - DNA, 20 bp, Homo sapiens
gcgcggggcgcccgggctgc

SEQ ID NO: 80812 - DNA, 21 bp, Homo sapiens
gcgcgggtagtgttgatgccg

SEQ ID NO: 80813 - DNA, 20 bp, Homo sapiens
gcgcggggctgggcgagggc

SEQ ID NO: 80814 - DNA, 16 bp, Homo sapiens
gcgcggggccgggccg

SEQ ID NO: 80815 - DNA, 19 bp, Homo sapiens
gcgtgggagcggttgccgc

SEQ ID NO: 80816 - DNA, 21 bp, Homo sapiens
ggcggggcggggacctgctgc

SEQ ID NO: 80817 - DNA, 17 bp, Homo sapiens
gcggggacagcgcccgc

SEQ ID NO: 80818 - DNA, 19 bp, Homo sapiens
gcgcgagggcggcacccgc

SEQ ID NO: 80819 - DNA, 19 bp, Homo sapiens
cgcggggctccgctgctgc

SEQ ID NO: 80820 - DNA, 20 bp, Homo sapiens
gcgcgcgggcagcccgccgc

SEQ ID NO: 80821 - DNA, 21 bp, Homo sapiens
gcgcaggggcggccacattgc

SEQ ID NO: 80822 - DNA, 19 bp, Homo sapiens
gccggggcaggttagccgc

SEQ ID NO: 80823 - DNA, 16 bp, Homo sapiens
gcgcggcggcggctgc

SEQ ID NO: 80824 - DNA, 18 bp, Homo sapiens
gccggggcaggccagggc

SEQ ID NO: 80825 - DNA, 18 bp, Homo sapiens
gcgcggggcggaggtcgc

SEQ ID NO: 80826 - DNA, 16 bp, Homo sapiens
gcgcggggctgagccg

SEQ ID NO: 80827 - DNA, 18 bp, Homo sapiens
gcgggtcattagtgccgc

SEQ ID NO: 80828 - DNA, 18 bp, Homo sapiens
gcgcgaggtagcacttgc

SEQ ID NO: 80829 - DNA, 17 bp, Homo sapiens
gcacggggcagggctcc

SEQ ID NO: 80830 - DNA, 16 bp, Homo sapiens
gcggggcaggcatccg

SEQ ID NO: 80831 - DNA, 19 bp, Homo sapiens
gcgggggcaggcctggtgc

SEQ ID NO: 80832 - DNA, 15 bp, Homo sapiens
gcgcggggggcgccg

SEQ ID NO: 80833 - DNA, 20 bp, Homo sapiens
gcggggctctgaagtgccgc

SEQ ID NO: 80834 - DNA, 15 bp, Homo sapiens
gcagagggcagtgcg

SEQ ID NO: 80835 - DNA, 19 bp, Homo sapiens
gcgcggggaagggagacgc

SEQ ID NO: 80836 - DNA, 19 bp, Homo sapiens
gcgcggggagcggagctgc

SEQ ID NO: 80837 - DNA, 20 bp, Homo sapiens
gcttggcagagcagtgctgc

SEQ ID NO: 80838 - DNA, 21 bp, Homo sapiens
gctgggcggccagtgtgctgc

SEQ ID NO: 80839 - DNA, 20 bp, Homo sapiens
gcggggggtgggcgcgccgc

SEQ ID NO: 80840 - DNA, 21 bp, Homo sapiens
gcgcgggagcttgcgtgctgc

SEQ ID NO: 80841 - DNA, 20 bp, Homo sapiens
acgtgggctacaggtgctgc

SEQ ID NO: 80842 - DNA, 18 bp, Homo sapiens
gcggggcaggtcccaggc

SEQ ID NO: 80843 - DNA, 16 bp, Homo sapiens
gcgctggccagtgccg

SEQ ID NO: 80844 - DNA, 19 bp, Homo sapiens
gcgctgggcagcaggttgc

SEQ ID NO: 80845 - DNA, 15 bp, Homo sapiens
gcgcggggaagctgc

SEQ ID NO: 80846 - DNA, 17 bp, Homo sapiens
gcagaggcaggcagtgc

SEQ ID NO: 80847 - DNA, 19 bp, Homo sapiens
gcgcgggggaggggagcgc

SEQ ID NO: 80848 - DNA, 18 bp, Homo sapiens
gcgcggggcaggaggtgc

SEQ ID NO: 80849 - DNA, 18 bp, Homo sapiens
gcctggggcaggtcaggc

SEQ ID NO: 80850 - DNA, 18 bp, Homo sapiens
acaaaaagcaggcagtgc

SEQ ID NO: 80851 - DNA, 17 bp, Homo sapiens
gcgcggggaaagggccg

SEQ ID NO: 80852 - DNA, 18 bp, Homo sapiens
cgcggggcagaactccgc

SEQ ID NO: 80853 - DNA, 16 bp, Homo sapiens
gcgcggagtggcgccg

SEQ ID NO: 80854 - DNA, 20 bp, Homo sapiens
gctggaagcagcggtgctgc

SEQ ID NO: 80855 - DNA, 19 bp, Homo sapiens
gcgcggggctgggcagtgc

SEQ ID NO: 80856 - DNA, 17 bp, Homo sapiens
gcgcgaggcaggcgggc

SEQ ID NO: 80857 - DNA, 20 bp, Homo sapiens
gcggggcaggaaggcgctgc

SEQ ID NO: 80858 - DNA, 16 bp, Homo sapiens
gccggggcaggctcgc

SEQ ID NO: 80859 - DNA, 16 bp, Homo sapiens
gcgcagggcgcagccg

SEQ ID NO: 80860 - DNA, 18 bp, Homo sapiens
gccggggcaggaggatcg

SEQ ID NO: 80861 - DNA, 20 bp, Homo sapiens
gcgcgggacaggctcagggc

SEQ ID NO: 80862 - DNA, 18 bp, Homo sapiens
gcgcggggactcggccgc

SEQ ID NO: 80863 - DNA, 18 bp, Homo sapiens
gcgcggagtcggtgctgc

SEQ ID NO: 80864 - DNA, 18 bp, Homo sapiens
gcgcgggcaggcaggtgc

SEQ ID NO: 80865 - DNA, 20 bp, Homo sapiens
gctggggcaggttcagatcg

SEQ ID NO: 80866 - DNA, 18 bp, Homo sapiens
gcgcggggcaggcaacgc

SEQ ID NO: 80867 - DNA, 18 bp, Homo sapiens
gcgcggggcggtagtgcc

SEQ ID NO: 80868 - DNA, 19 bp, Homo sapiens
gcgcgggggaggccggcgc

SEQ ID NO: 80869 - DNA, 19 bp, Homo sapiens
gcgcggggcagagctgagc

SEQ ID NO: 80870 - DNA, 17 bp, Homo sapiens
gcgtggggtggcaacgc

SEQ ID NO: 80871 - DNA, 19 bp, Homo sapiens
gcgccgggcgcagtgccgc

SEQ ID NO: 80872 - DNA, 15 bp, Homo sapiens
gcgcggggcagcccg

SEQ ID NO: 80873 - DNA, 15 bp, Homo sapiens
gcacggggcggcccg

SEQ ID NO: 80874 - DNA, 16 bp, Homo sapiens
gcacggggtaggctgc

SEQ ID NO: 80875 - DNA, 16 bp, Homo sapiens
gcgcggggaggagccg

SEQ ID NO: 80876 - DNA, 18 bp, Homo sapiens
gcgggggcaggatgacgc

SEQ ID NO: 80877 - DNA, 18 bp, Homo sapiens
gcttgggaccagtgctgc

SEQ ID NO: 80878 - DNA, 16 bp, Homo sapiens
gcatggggcaggctgc

SEQ ID NO: 80879 - DNA, 21 bp, Homo sapiens
gcgtggggcaggggctcccgc

SEQ ID NO: 80880 - DNA, 17 bp, Homo sapiens
gcgcggggcggcgaggc

SEQ ID NO: 80881 - DNA, 76 bp, Cercopithecine herpesvirus 7
atgcaatattactaatattttcacacgcttatatacctattggacaatgttgtatatcccacccctaatattgcat

SEQ ID NO: 80882 - DNA, 24 bp, Cercopithecine herpesvirus 7
gcaatattactaatattttcacac

SEQ ID NO: 80883 - DNA, 20 bp, Homo sapiens
gcaaattaaatattttcaca

SEQ ID NO: 80884 - DNA, 20 bp, Homo sapiens
acataacaatattttcacac

SEQ ID NO: 80885 - DNA, 18 bp, Homo sapiens
attacacttattttcaca

SEQ ID NO: 80886 - DNA, 20 bp, Homo sapiens
gcaatattattaataatcac

SEQ ID NO: 80887 - DNA, 21 bp, Homo sapiens
gcatatcctttaatattttca

SEQ ID NO: 80888 - DNA, 22 bp, Homo sapiens
gcaatataactaacacaataca

SEQ ID NO: 80889 - DNA, 24 bp, Homo sapiens
gcatatgtgcatatattttcacac

SEQ ID NO: 80890 - DNA, 23 bp, Homo sapiens
gcaatattactaaagtagccaca

SEQ ID NO: 80891 - DNA, 23 bp, Homo sapiens
gctgtattactagtgacctcaca

SEQ ID NO: 80892 - DNA, 24 bp, Homo sapiens
gcatataactccatattttcacac

SEQ ID NO: 80893 - DNA, 21 bp, Homo sapiens
gcaatatactaataagaacac

SEQ ID NO: 80894 - DNA, 20 bp, Homo sapiens
gcaatatttctcctattcac

SEQ ID NO: 80895 - DNA, 18 bp, Homo sapiens
acaatattaattttcaca

SEQ ID NO: 80896 - DNA, 21 bp, Homo sapiens
gcatattacagcatttcacac

SEQ ID NO: 80897 - DNA, 72 bp, Fowlpox virus
atcgcagaatgtataaagaatataatactaaactttgctctagtagacatactgatattcattatacacgat

SEQ ID NO: 80898 - DNA, 24 bp, Fowlpox virus
aagaatataatactaaactttgct

SEQ ID NO: 80899 - DNA, 18 bp, Homo sapiens
gaatataatgactttgct

SEQ ID NO: 80900 - DNA, 22 bp, Homo sapiens
agaatataatgctcttcctgct

SEQ ID NO: 80901 - DNA, 21 bp, Homo sapiens
aagaacatgatcttctttgct

SEQ ID NO: 80902 - DNA, 21 bp, Homo sapiens
agaacacaactgaattttgct

SEQ ID NO: 80903 - DNA, 15 bp, Homo sapiens
gaatataaactttgc

SEQ ID NO: 80904 - DNA, 65 bp, Fowlpox virus
agttctattacattgctagctacttgtaggaatgctaaagtacttatagaatttagtatagaact

SEQ ID NO: 80905 - DNA, 21 bp, Fowlpox virus
tatagaatttagtatagaact

SEQ ID NO: 80906 - DNA, 19 bp, Homo sapiens
tatagattttagtataaaa

SEQ ID NO: 80907 - DNA, 19 bp, Homo sapiens
taagaatttagtactaact

SEQ ID NO: 80908 - DNA, 19 bp, Homo sapiens
tatagattttagtacagaa

SEQ ID NO: 80909 - DNA, 18 bp, Homo sapiens
tatagaatctaaggcaga

SEQ ID NO: 80910 - DNA, 17 bp, Homo sapiens
atagaacagatagaact

SEQ ID NO: 80911 - DNA, 20 bp, Homo sapiens
taaaaatatggtatagaact

SEQ ID NO: 80912 - DNA, 18 bp, Homo sapiens
tagaatttaaacaaaact

SEQ ID NO: 80913 - DNA, 20 bp, Homo sapiens
tatagaattacttaagaact

SEQ ID NO: 80914 - DNA, 17 bp, Homo sapiens
atagaatttagttagaa

SEQ ID NO: 80915 - DNA, 19 bp, Homo sapiens
tataaaatggagtatagaa

SEQ ID NO: 80916 - DNA, 19 bp, Homo sapiens
tatggaaatgtatagaact

SEQ ID NO: 80917 - DNA, 19 bp, Homo sapiens
tataaaatttagcttaaga

SEQ ID NO: 80918 - DNA, 24 bp, Homo sapiens
tgagaatttagtaataggagaact

SEQ ID NO: 80919 - DNA, 21 bp, Homo sapiens
tacagaatttcacaaagaact

SEQ ID NO: 80920 - DNA, 116 bp, Ophiostoma mitovirus 3a
cttagagactactttgtctttcaaatatgactactccctctcatccattggtctgttaaaccaatgtggtgatgataggtaagatgcaaatttaaaggcttatgtatatctctaag

SEQ ID NO: 80921 - DNA, 24 bp, Ophiostoma mitovirus 3a
tactttgtctttcaaatatgacta

SEQ ID NO: 80922 - DNA, 20 bp, Homo sapiens
tacttttctttcaaaagact

SEQ ID NO: 80923 - DNA, 19 bp, Homo sapiens
tactttgtctttaatacat

SEQ ID NO: 80924 - DNA, 17 bp, Homo sapiens
tttgttttcacatgact

SEQ ID NO: 80925 - DNA, 20 bp, Homo sapiens
cttatgctcagatatgacta

SEQ ID NO: 80926 - DNA, 17 bp, Homo sapiens
tttgtctttcaaaaact

SEQ ID NO: 80927 - DNA, 22 bp, Homo sapiens
tactttttctttgccattgact

SEQ ID NO: 80928 - DNA, 21 bp, Homo sapiens
ctctgtcttcacatatgacta

SEQ ID NO: 80929 - DNA, 18 bp, Homo sapiens
tacttgcaaaatatgact

SEQ ID NO: 80930 - DNA, 20 bp, Homo sapiens
tactttgtctttttaaatac

SEQ ID NO: 80931 - DNA, 18 bp, Homo sapiens
taccttgaaaatatgact

SEQ ID NO: 80932 - DNA, 19 bp, Homo sapiens
cactttgtcatgtatgact

SEQ ID NO: 80933 - DNA, 19 bp, Homo sapiens
tttgtctttggcaatatga

SEQ ID NO: 80934 - DNA, 22 bp, Homo sapiens
tacattgtcttttgtaggacta

SEQ ID NO: 80935 - DNA, 20 bp, Homo sapiens
actttgttctaaatatgact

SEQ ID NO: 80936 - DNA, 16 bp, Homo sapiens
tttgtctttcaagact

SEQ ID NO: 80937 - DNA, 19 bp, Homo sapiens
tacttgtctttcaacactg

SEQ ID NO: 80938 - DNA, 130 bp, Sulfolobus virus SIRV-2
ttatatcttcttatttttttatgcttacaatttctgcagaattagaattagtatctggaaagtgagaaaaattaaagataaaattaaataatttgtggaaaattaaaaattagaagaactagaattaata

SEQ ID NO: 80939 - DNA, 24 bp, Sulfolobus virus SIRV-2
tatttttttatgcttacaatttct

SEQ ID NO: 80940 - DNA, 20 bp, Homo sapiens
tatttttctatttacaattt

SEQ ID NO: 80941 - DNA, 22 bp, Homo sapiens
tatttcttcatttgcaatttct

SEQ ID NO: 80942 - DNA, 91 bp, Lymphocystis disease virus 1
ttgacgataaacctatagagttgctttagcattaataaatgtaaaactatatagtatatatttattaccgttgattgtaataatacgtcaa

SEQ ID NO: 80943 - DNA, 24 bp, Lymphocystis disease virus 1
tagcattaataaatgtaaaactat

SEQ ID NO: 80944 - DNA, 25 bp, Homo sapiens
tagcattaatagcttacgttactat

SEQ ID NO: 80945 - DNA, 20 bp, Homo sapiens
gcactagagtgtaaaactat

SEQ ID NO: 80946 - DNA, 22 bp, Homo sapiens
tagcatgtgacaataaaactat

SEQ ID NO: 80947 - DNA, 60 bp, Gallid herpesvirus 3
cccaggtttctgttcggtctgctactacgatcagatcagtggcgcgatcagatgcgtggg

SEQ ID NO: 80948 - DNA, 24 bp, Gallid herpesvirus 3
tctgttcggtctgctactacgatc

SEQ ID NO: 80949 - DNA, 21 bp, Homo sapiens
ctgttccaatctgctgtgatc

SEQ ID NO: 80950 - DNA, 82 bp, Clover yellow vein virus
gcaagttacacaaacaaagcaaagtaagccaacagttttctgtaagatcatttcagtttcgtctttctttaatcgtacttgc

SEQ ID NO: 80951 - DNA, 24 bp, Clover yellow vein virus
taagatcatttcagtttcgtcttt

SEQ ID NO: 80952 - DNA, 19 bp, Homo sapiens
agggtcatttcagttgacg

SEQ ID NO: 80953 - DNA, 22 bp, Homo sapiens
taagatcattgtcctggtcttt

SEQ ID NO: 80954 - DNA, 20 bp, Homo sapiens
gacatttcagccacctcttt

SEQ ID NO: 80955 - DNA, 18 bp, Homo sapiens
gatcacttctggttttgt

SEQ ID NO: 80956 - DNA, 17 bp, Homo sapiens
taagatcatttggtttc

SEQ ID NO: 80957 - DNA, 18 bp, Homo sapiens
taaggccatttcagtttc

SEQ ID NO: 80958 - DNA, 17 bp, Homo sapiens
aaatcatttcaggcctt

SEQ ID NO: 80959 - DNA, 126 bp, Cercopithecine herpesvirus 7
actggaatgtactgggatgtactaagggcgtggtttgtttacatttttaacacaaaataaaagtcttgttcatgtgactttgtataatttactaccaacctttaaatgtttcatattataaaaagt

SEQ ID NO: 80960 - DNA, 24 bp, Cercopithecine herpesvirus 7
ttcatgtgactttgtataatttac

SEQ ID NO: 80961 - DNA, 19 bp, Homo sapiens
ttcatgtgatttctgtaca

SEQ ID NO: 80962 - DNA, 20 bp, Homo sapiens
ttcatgtgactttcgtgtat

SEQ ID NO: 80963 - DNA, 18 bp, Homo sapiens
tatgaaagtataatttac

SEQ ID NO: 80964 - DNA, 20 bp, Homo sapiens
ttcgtgtgacttttaattta

SEQ ID NO: 80965 - DNA, 22 bp, Homo sapiens
ttcagtgacttaaataatttac

SEQ ID NO: 80966 - DNA, 22 bp, Homo sapiens
ttcagtgattcccataatttac

SEQ ID NO: 80967 - DNA, 20 bp, Homo sapiens
ttcatgtgatttttctctgt

SEQ ID NO: 80968 - DNA, 19 bp, Homo sapiens
ttcatgtggacttaaatgt

SEQ ID NO: 80969 - DNA, 76 bp, Apple chlorotic leaf spot virus
agagtataaagagtcatggtatttaattggagtgtttagacttataataaatagcctgtagacttttaaatatttt

SEQ ID NO: 80970 - DNA, 24 bp, Apple chlorotic leaf spot virus
taaagagtcatggtatttaattgg

SEQ ID NO: 80971 - DNA, 22 bp, Homo sapiens
aagagggtcatggtggacatgg

SEQ ID NO: 80972 - DNA, 22 bp, Homo sapiens
taaaggtcatacagctaattgg

SEQ ID NO: 80973 - DNA, 17 bp, Homo sapiens
taaaggtcatggtattt

SEQ ID NO: 80974 - DNA, 21 bp, Homo sapiens
aagagagtagcatttggttgg

SEQ ID NO: 80975 - DNA, 23 bp, Homo sapiens
taaagatcatggctgtaggttgg

SEQ ID NO: 80976 - DNA, 22 bp, Homo sapiens
taaacagttgaaatttaattgg

SEQ ID NO: 80977 - DNA, 17 bp, Homo sapiens
gagttatatttaattgg

SEQ ID NO: 80978 - DNA, 85 bp, Human respiratory syncytial virus
tgctctaccatcatgctgtgtcaaattataatcctgtatatataaacaaacaaatccaatcttctcacagagtcatggtgtcgca

SEQ ID NO: 80979 - DNA, 24 bp, Human respiratory syncytial virus
tctaccatcatgctgtgtcaaatt

SEQ ID NO: 80980 - DNA, 16 bp, Homo sapiens
tctgccatcggccaaa

SEQ ID NO: 80981 - DNA, 18 bp, Homo sapiens
tctatgtcatgtgccaaa

SEQ ID NO: 80982 - DNA, 19 bp, Homo sapiens
cctgccatcatgctgccca

SEQ ID NO: 80983 - DNA, 18 bp, Homo sapiens
tctatgtctatgtcaaat

SEQ ID NO: 80984 - DNA, 19 bp, Homo sapiens
taccaagactctgtgtcaa

SEQ ID NO: 80985 - DNA, 19 bp, Homo sapiens
tctaccattgctgggcaca

SEQ ID NO: 80986 - DNA, 17 bp, Homo sapiens
atcatctttgtcaaatt

SEQ ID NO: 80987 - DNA, 20 bp, Homo sapiens
tctgcagtcatgctgaccca

SEQ ID NO: 80988 - DNA, 83 bp, Apple latent spherical virus
ttctttctttcttttgaactagtttgttctcgtgatccttggatccgttaaggtttcttgctggttcttccttaagatgagaa

SEQ ID NO: 80989 - DNA, 24 bp, Apple latent spherical virus
ttgaactagtttgttctcgtgatc

SEQ ID NO: 80990 - DNA, 21 bp, Homo sapiens
ttgaattaggttttctgtgat

SEQ ID NO: 80991 - DNA, 18 bp, Homo sapiens
agcgctgttttcgtgatc

SEQ ID NO: 80992 - DNA, 67 bp, Cercopithecine herpesvirus 7
caatttaatactagttgtacattccatgtaatacttatttatatagacgttttaaattagtttattg

SEQ ID NO: 80993 - DNA, 24 bp, Cercopithecine herpesvirus 7
tttaatactagttgtacattccat

SEQ ID NO: 80994 - DNA, 18 bp, Homo sapiens
tttaatacagttgaacca

SEQ ID NO: 80995 - DNA, 25 bp, Homo sapiens
cttaatattagttgtagatgaccat

SEQ ID NO: 80996 - DNA, 21 bp, Homo sapiens
aatactagttgtatacctcat

SEQ ID NO: 80997 - DNA, 23 bp, Homo sapiens
tttaatacaattgaacatttcat

SEQ ID NO: 80998 - DNA, 23 bp, Homo sapiens
tttaacactgaataatattccat

SEQ ID NO: 80999 - DNA, 60 bp, Sulfolobus virus SIRV-1
aatagttttgtgtattacattatatagtataatatatagtatataatttccgggattatt

SEQ ID NO: 81000 - DNA, 24 bp, Sulfolobus virus SIRV-1
tagtatataatttccgggattatt

SEQ ID NO: 81001 - DNA, 18 bp, Homo sapiens
cagtatatgatttcttgg

SEQ ID NO: 81002 - DNA, 25 bp, Homo sapiens
tagtatatgcatatgatggattatt

SEQ ID NO: 81003 - DNA, 70 bp, Ovine adenovirus A
tggaagagattttctaacgccgcgactaaagagctgtggtaaaagactttaacgtgcgtgccgtcttcta

SEQ ID NO: 81004 - DNA, 21 bp, Ovine adenovirus A
taacgtgcgtgccgtcttcta

SEQ ID NO: 81005 - DNA, 20 bp, Homo sapiens
tacgttccttctgtcttcta

SEQ ID NO: 81006 - DNA, 18 bp, Homo sapiens
tgcgtgcacaactcttct

SEQ ID NO: 81007 - DNA, 19 bp, Homo sapiens
atacataagttgtcttcta

SEQ ID NO: 81008 - DNA, 21 bp, Homo sapiens
taacatcacaaatgtcttcta

SEQ ID NO: 81009 - DNA, 18 bp, Homo sapiens
gtgctatttcgtcttcta

SEQ ID NO: 81010 - DNA, 18 bp, Homo sapiens
taactgtgggcatcttct

SEQ ID NO: 81011 - DNA, 17 bp, Homo sapiens
taacgtgctgctcttct

SEQ ID NO: 81012 - DNA, 18 bp, Homo sapiens
caacgccgctgtcttcta

SEQ ID NO: 81013 - DNA, 18 bp, Homo sapiens
taatggtaaagtcttcta

SEQ ID NO: 81014 - DNA, 18 bp, Homo sapiens
gtggcagagccgtcttct

SEQ ID NO: 81015 - DNA, 21 bp, Homo sapiens
caactgagacgttgtcttcta

SEQ ID NO: 81016 - DNA, 15 bp, Homo sapiens
acgtgcagctcttct

SEQ ID NO: 81017 - DNA, 20 bp, Homo sapiens
caatacctttgccgtcttct

SEQ ID NO: 81018 - DNA, 91 bp, Sugarcane striate mosaic associated virus
cttttatcaccggctgcactgatcaaaagtggttggatactgcaatcaaacacctgagaccagacaatcaaagatcaggttggtttagaag

SEQ ID NO: 81019 - DNA, 24 bp, Sugarcane striate mosaic associated virus
agaccagacaatcaaagatcaggt

SEQ ID NO: 81020 - DNA, 21 bp, Homo sapiens
gaccaggcaagcggagagggt

SEQ ID NO: 81021 - DNA, 25 bp, Homo sapiens
agaccagatatttaaatcaactggt

SEQ ID NO: 81022 - DNA, 17 bp, Homo sapiens
cagagaacaaatcaggt

SEQ ID NO: 81023 - DNA, 19 bp, Homo sapiens
gatcagataatcaatcagg

SEQ ID NO: 81024 - DNA, 22 bp, Homo sapiens
agaccagggaatcactttcagg

SEQ ID NO: 81025 - DNA, 19 bp, Homo sapiens
agctcagacaattggaagg

SEQ ID NO: 81026 - DNA, 19 bp, Homo sapiens
agccagacaattaaaacag

SEQ ID NO: 81027 - DNA, 23 bp, Homo sapiens
agccagacagcgctcgatcaggt

SEQ ID NO: 81028 - DNA, 20 bp, Homo sapiens
agatcaggaaatcaaggacc

SEQ ID NO: 81029 - DNA, 22 bp, Homo sapiens
aaaccagatagtcaaattaagt

SEQ ID NO: 81030 - DNA, 21 bp, Homo sapiens
agaccagatgctcaaggaaca

SEQ ID NO: 81031 - DNA, 23 bp, Homo sapiens
agaccagataatctggctctggt

SEQ ID NO: 81032 - DNA, 23 bp, Homo sapiens
agaccagatgaatcaaggaaaag

SEQ ID NO: 81033 - DNA, 21 bp, Homo sapiens
agacgggatggtcaatcaggt

SEQ ID NO: 81034 - DNA, 16 bp, Homo sapiens
agactgacaatcaaga

SEQ ID NO: 81035 - DNA, 23 bp, Homo sapiens
gaccagccgagagcagatcaggt

SEQ ID NO: 81036 - DNA, 24 bp, Homo sapiens
agattagaagtcaaagatcaaggt

SEQ ID NO: 81037 - DNA, 21 bp, Homo sapiens
gatcaggacaatcaaccaggt

SEQ ID NO: 81038 - DNA, 23 bp, Homo sapiens
agaccaggacaattaggtttggt

SEQ ID NO: 81039 - DNA, 19 bp, Homo sapiens
caggacaatcatatgaggt

SEQ ID NO: 81040 - DNA, 20 bp, Homo sapiens
gactggaaaatcagtccagg

SEQ ID NO: 81041 - DNA, 22 bp, Homo sapiens
agaccaggtaatcaatgcagat

SEQ ID NO: 81042 - DNA, 21 bp, Homo sapiens
gactgacaatcaaaaacaggt

SEQ ID NO: 81043 - DNA, 20 bp, Homo sapiens
agaccagatattcagagacc

SEQ ID NO: 81044 - DNA, 19 bp, Homo sapiens
ccagaacttaagatcaggt

SEQ ID NO: 81045 - DNA, 21 bp, Homo sapiens
agaccagacagcaggacatgg

SEQ ID NO: 81046 - DNA, 19 bp, Homo sapiens
accagacagtcaagcaggt

SEQ ID NO: 81047 - DNA, 24 bp, Homo sapiens
agaccaggctggtcctacccaggt

SEQ ID NO: 81048 - DNA, 20 bp, Homo sapiens
gactgacggaccaatcaggt

SEQ ID NO: 81049 - DNA, 130 bp, Rat cytomegalovirus
gatataattttatgtatgtggagtggaagcggagcgtgatatattgcgatgtgaagcagaggcggatgagccgggttggatatccaatcaattgagtactgtggccttttaaatatgggaatgttatgtc

SEQ ID NO: 81050 - DNA, 24 bp, Rat cytomegalovirus
tgtggagtggaagcggagcgtgat

SEQ ID NO: 81051 - DNA, 19 bp, Homo sapiens
tgtggagtgaaggcggcgt

SEQ ID NO: 81052 - DNA, 17 bp, Homo sapiens
tgtggagtggagtggag

SEQ ID NO: 81053 - DNA, 18 bp, Homo sapiens
tgtggggtgaggcggggc

SEQ ID NO: 81054 - DNA, 21 bp, Homo sapiens
tgaggggtgggagcagctgat

SEQ ID NO: 81055 - DNA, 19 bp, Homo sapiens
tgtgcagtggaagcgaggt

SEQ ID NO: 81056 - DNA, 18 bp, Homo sapiens
tgtggagtgggggctgtg

SEQ ID NO: 81057 - DNA, 17 bp, Homo sapiens
tggagtggaggtgcacg

SEQ ID NO: 81058 - DNA, 80 bp, Cherry necrotic rusty mottle virus
acttgaaacctcattcacatagcttaggtttttaggcactccaatttgaatattatttgagtgtgtgtgagctttcaagt

SEQ ID NO: 81059 - DNA, 24 bp, Cherry necrotic rusty mottle virus
ttatttgagtgtgtgtgagctttc

SEQ ID NO: 81060 - DNA, 19 bp, Homo sapiens
ttatttaagcatgggcttt

SEQ ID NO: 81061 - DNA, 21 bp, Homo sapiens
tttgggtctgtgtaaaggttc

SEQ ID NO: 81062 - DNA, 22 bp, Homo sapiens
tcatttgagttatctgagtttt

SEQ ID NO: 81063 - DNA, 18 bp, Homo sapiens
tttgagtgtgagagtttt

SEQ ID NO: 81064 - DNA, 19 bp, Homo sapiens
ttgtctgggtgtcagcttt

SEQ ID NO: 81065 - DNA, 21 bp, Homo sapiens
tattttgtatgtgtgggcttt

SEQ ID NO: 81066 - DNA, 19 bp, Homo sapiens
ttctttgggtgtgagtttt

SEQ ID NO: 81067 - DNA, 21 bp, Homo sapiens
ttcacctgtgtgtgggctttc

SEQ ID NO: 81068 - DNA, 18 bp, Homo sapiens
atttgatctgtgagcttt

SEQ ID NO: 81069 - DNA, 85 bp, Variola virus
ttagtattaattgctaccgttacattgtacaaatggagatattccctgtatttggcatttctaaaattagcaattttattgctaa

SEQ ID NO: 81070 - DNA, 24 bp, Variola virus
ttaattgctaccgttacattgtac

SEQ ID NO: 81071 - DNA, 22 bp, Homo sapiens
ttaattgccattgtaacagtgt

SEQ ID NO: 81072 - DNA, 19 bp, Homo sapiens
ttaattgcacacagttgta

SEQ ID NO: 81073 - DNA, 16 bp, Homo sapiens
attgctacacattgta

SEQ ID NO: 81074 - DNA, 23 bp, Homo sapiens
ttaattgctgccattccagttgc

SEQ ID NO: 81075 - DNA, 21 bp, Homo sapiens
ttaatagctttgatacattgt

SEQ ID NO: 81076 - DNA, 80 bp, Human papillomavirus type 15
gtgactaaaccgcataggtcattgccaacaaccgcacccggttaatcagatataaaatgcacctggtgcgattttatcac

SEQ ID NO: 81077 - DNA, 21 bp, Human papillomavirus type 15
cacctggtgcgattttatcac

SEQ ID NO: 81078 - DNA, 20 bp, Homo sapiens
cacctggtgcaaggcctcac

SEQ ID NO: 81079 - DNA, 16 bp, Homo sapiens
cctggggcttcatcac

SEQ ID NO: 81080 - DNA, 17 bp, Homo sapiens
ctgtgtcattttatcac

SEQ ID NO: 81081 - DNA, 17 bp, Homo sapiens
cacctggtgaccccatc

SEQ ID NO: 81082 - DNA, 18 bp, Homo sapiens
cacctgctgtttctatca

SEQ ID NO: 81083 - DNA, 17 bp, Homo sapiens
cacctagtgaatattac

SEQ ID NO: 81084 - DNA, 20 bp, Homo sapiens
acactggatgtttttatcac

SEQ ID NO: 81085 - DNA, 20 bp, Homo sapiens
cacttgtgctattttatcac

SEQ ID NO: 81086 - DNA, 16 bp, Homo sapiens
ctgatcattttatcac

SEQ ID NO: 81087 - DNA, 19 bp, Homo sapiens
ccgggctgccctttatcac

SEQ ID NO: 81088 - DNA, 18 bp, Homo sapiens
cctggacccatttatcac

SEQ ID NO: 81089 - DNA, 15 bp, Homo sapiens
acctcaattttatca

SEQ ID NO: 81090 - DNA, 19 bp, Homo sapiens
tggtaactggattttatca

SEQ ID NO: 81091 - DNA, 18 bp, Homo sapiens
cacttgtacttttatcac

SEQ ID NO: 81092 - DNA, 19 bp, Homo sapiens
catctggagactttatcac

SEQ ID NO: 81093 - DNA, 17 bp, Homo sapiens
cccggctaattttatca

SEQ ID NO: 81094 - DNA, 23 bp, Homo sapiens
cactttgtgcttcatcttatcac

SEQ ID NO: 81095 - DNA, 17 bp, Homo sapiens
acctggacatttatcac

SEQ ID NO: 81096 - DNA, 19 bp, Homo sapiens
taatacaagattttatcac

SEQ ID NO: 81097 - DNA, 15 bp, Homo sapiens
acctgaactttatca

SEQ ID NO: 81098 - DNA, 20 bp, Homo sapiens
cctgatgcggattgggtcac

SEQ ID NO: 81099 - DNA, 16 bp, Homo sapiens
cacctgctccttatca

SEQ ID NO: 81100 - DNA, 18 bp, Homo sapiens
ccctatgcaattttgtca

SEQ ID NO: 81101 - DNA, 20 bp, Homo sapiens
cacctgtgtggaccactcac

SEQ ID NO: 81102 - DNA, 18 bp, Homo sapiens
ctgaaacatttttatcac

SEQ ID NO: 81103 - DNA, 17 bp, Homo sapiens
cacctggtcaaggttac

SEQ ID NO: 81104 - DNA, 21 bp, Homo sapiens
cacatgcacattttttatcac

SEQ ID NO: 81105 - DNA, 22 bp, Homo sapiens
ctggtgcgtgaatcttttatca

SEQ ID NO: 81106 - DNA, 21 bp, Homo sapiens
cacctggttctgtggcatttt

SEQ ID NO: 81107 - DNA, 21 bp, Homo sapiens
cacctggtctgcagccgtcac

SEQ ID NO: 81108 - DNA, 17 bp, Homo sapiens
cctgtgcagcccatcac

SEQ ID NO: 81109 - DNA, 18 bp, Homo sapiens
tggtgacatacttatcac

SEQ ID NO: 81110 - DNA, 17 bp, Homo sapiens
ctaagcagttttatcac

SEQ ID NO: 81111 - DNA, 17 bp, Homo sapiens
acctcaccattttatca

SEQ ID NO: 81112 - DNA, 19 bp, Homo sapiens
cacctggcctattttatca

SEQ ID NO: 81113 - DNA, 16 bp, Homo sapiens
cacctgctgtccatca

SEQ ID NO: 81114 - DNA, 17 bp, Homo sapiens
cacctggtggatttcat

SEQ ID NO: 81115 - DNA, 18 bp, Homo sapiens
cctggtgcgacccactca

SEQ ID NO: 81116 - DNA, 17 bp, Homo sapiens
cttgtacattttatcac

SEQ ID NO: 81117 - DNA, 18 bp, Homo sapiens
cacctagtcattttgtca

SEQ ID NO: 81118 - DNA, 17 bp, Homo sapiens
cacctggtggattttat

SEQ ID NO: 81119 - DNA, 19 bp, Homo sapiens
ccatctgcacttttatcac

SEQ ID NO: 81120 - DNA, 21 bp, Homo sapiens
cacctggtttgcagccgtcac

SEQ ID NO: 81121 - DNA, 17 bp, Homo sapiens
acctggtggcttgtcac

SEQ ID NO: 81122 - DNA, 16 bp, Homo sapiens
cacctagcctttgtca

SEQ ID NO: 81123 - DNA, 17 bp, Homo sapiens
ccttgtagattttatca

SEQ ID NO: 81124 - DNA, 20 bp, Homo sapiens
ccttggtgggaatttatcac

SEQ ID NO: 81125 - DNA, 15 bp, Homo sapiens
cctggtgctcatcac

SEQ ID NO: 81126 - DNA, 18 bp, Homo sapiens
cacttgctgcttcatcac

SEQ ID NO: 81127 - DNA, 16 bp, Homo sapiens
acctgatgccatatca

SEQ ID NO: 81128 - DNA, 20 bp, Homo sapiens
cacctggtggctccttttat

SEQ ID NO: 81129 - DNA, 20 bp, Homo sapiens
acctggtacctccccgtcac

SEQ ID NO: 81130 - DNA, 15 bp, Homo sapiens
cacctgggcccatca

SEQ ID NO: 81131 - DNA, 69 bp, Human herpesvirus 5
gccaaaagttgcgtgtctgagtggacgtgggtttttatagagtcgtcctaagcgcgtgcggcgggtggc

SEQ ID NO: 81132 - DNA, 24 bp, Human herpesvirus 5
aagttgcgtgtctgagtggacgtg

SEQ ID NO: 81133 - DNA, 20 bp, Homo sapiens
gctgtgctgtggtggacgtg

SEQ ID NO: 81134 - DNA, 18 bp, Homo sapiens
gttgcgtgtttccgtgtg

SEQ ID NO: 81135 - DNA, 19 bp, Homo sapiens
gtgcactggggtggacgtg

SEQ ID NO: 81136 - DNA, 20 bp, Homo sapiens
agtagcgtgtctgaagagtg

SEQ ID NO: 81137 - DNA, 22 bp, Homo sapiens
aagttgctgtctgagacccatg

SEQ ID NO: 81138 - DNA, 21 bp, Homo sapiens
agttcacattgagtggatgtg

SEQ ID NO: 81139 - DNA, 20 bp, Homo sapiens
gttattgctgagtgggtgtg

SEQ ID NO: 81140 - DNA, 23 bp, Homo sapiens
aagttgtgtgtcacaggggtgtg

SEQ ID NO: 81141 - DNA, 81 bp, Fowlpox virus
ggttaatttataagaaaccaatactttaaatctctaattcgttgttctaaacaacagttatggtttcttaaattgttgatt

SEQ ID NO: 81142 - DNA, 24 bp, Fowlpox virus
tataagaaaccaatactttaaatc

SEQ ID NO: 81143 - DNA, 19 bp, Homo sapiens
aaaccagatgctttaaatc

SEQ ID NO: 81144 - DNA, 22 bp, Homo sapiens
tatagagaaaaacactttaaat

SEQ ID NO: 81145 - DNA, 23 bp, Homo sapiens
taagaaaccagttaccataaatc

SEQ ID NO: 81146 - DNA, 20 bp, Homo sapiens
taagaaatttaccttaaatc

SEQ ID NO: 81147 - DNA, 22 bp, Homo sapiens
taagaaaccatttacacaaaat

SEQ ID NO: 81148 - DNA, 22 bp, Homo sapiens
tacaagaaaccaatttttaaat

SEQ ID NO: 81149 - DNA, 19 bp, Homo sapiens
taagaaatcaactttaaat

SEQ ID NO: 81150 - DNA, 96 bp, Tobacco etch virus
cttttaagcttattgtaatatatatgaatagctattcacagtgggacttggtcttgtgttgaatagtatcttatatattttaatatgtcttattag

SEQ ID NO: 81151 - DNA, 24 bp, Tobacco etch virus
tttaagcttattgtaatatatatg

SEQ ID NO: 81152 - DNA, 18 bp, Homo sapiens
tttaagcttatttaatat

SEQ ID NO: 81153 - DNA, 17 bp, Homo sapiens
cccttgtaatatatatg

SEQ ID NO: 81154 - DNA, 22 bp, Homo sapiens
ttcaagctagaggatatatatg

SEQ ID NO: 81155 - DNA, 21 bp, Homo sapiens
tttaagcttactttgtatatg

SEQ ID NO: 81156 - DNA, 23 bp, Homo sapiens
tctaagcacacttgatatatatg

SEQ ID NO: 81157 - DNA, 25 bp, Homo sapiens
tctaagtttaatatatatatatatg

SEQ ID NO: 81158 - DNA, 61 bp, Camelpox virus
gtataatttttttagtttttatagattctttattctatacttaaaaaatgaaaataaatac

SEQ ID NO: 81159 - DNA, 24 bp, Camelpox virus
taatttttttagtttttatagatt

SEQ ID NO: 81160 - DNA, 21 bp, Homo sapiens
taatttttttactttttgtag

SEQ ID NO: 81161 - DNA, 22 bp, Homo sapiens
taatttttttagtttttataga

SEQ ID NO: 81162 - DNA, 18 bp, Homo sapiens
ttctaatttttatagatt

SEQ ID NO: 81163 - DNA, 91 bp, Paramecium bursaria Chlorella virus 1
ttggattattcatttttatgaactatgttatttacaaagcttcgaaagtgagtatattgtgcagacgtggttcttgggttgttgtaaacga

SEQ ID NO: 81164 - DNA, 24 bp, Paramecium bursaria Chlorella virus 1
tattgtgcagacgtggttcttggg

SEQ ID NO: 81165 - DNA, 19 bp, Homo sapiens
ttgtgtgaagtctcttggg

SEQ ID NO: 81166 - DNA, 17 bp, Homo sapiens
ttgtgcaggagttttgg

SEQ ID NO: 81167 - DNA, 86 bp, Common chimpanzee papillomavirus 1
taacgtgtagttttgatgatggtgacacatggttgttgttatggcttttagcatcacttattgttgctattttagggttactgtta

SEQ ID NO: 81168 - DNA, 24 bp, Common chimpanzee papillomavirus 1
atgatggtgacacatggttgttgt

SEQ ID NO: 81169 - DNA, 19 bp, Homo sapiens
tgatgtgacacagtgttgt

SEQ ID NO: 81170 - DNA, 21 bp, Homo sapiens
tgaggtgggtgtcgttgttgt

SEQ ID NO: 81171 - DNA, 19 bp, Homo sapiens
tggtggtgacatgtgagct

SEQ ID NO: 81172 - DNA, 18 bp, Homo sapiens
tgatggtggtggtgcagc

SEQ ID NO: 81173 - DNA, 18 bp, Homo sapiens
atgatggtaaggtgttgt

SEQ ID NO: 81174 - DNA, 17 bp, Homo sapiens
tgatggtgatggtgctg

SEQ ID NO: 81175 - DNA, 17 bp, Homo sapiens
tgatggtacataattgt

SEQ ID NO: 81176 - DNA, 22 bp, Homo sapiens
tggtggggtggcatactgttgt

SEQ ID NO: 81177 - DNA, 17 bp, Homo sapiens
atgatggtggtggtggt

SEQ ID NO: 81178 - DNA, 19 bp, Homo sapiens
tgatggtgaccgtgactgt

SEQ ID NO: 81179 - DNA, 18 bp, Homo sapiens
tggtggcatagctgttgt

SEQ ID NO: 81180 - DNA, 23 bp, Homo sapiens
atgatggtgatagtaggttttgt

SEQ ID NO: 81181 - DNA, 19 bp, Homo sapiens
tgtggtgacacatgcctgt

SEQ ID NO: 81182 - DNA, 23 bp, Homo sapiens
atgatggtgacgtatagatgagt

SEQ ID NO: 81183 - DNA, 19 bp, Homo sapiens
tgatggtgactataactgt

SEQ ID NO: 81184 - DNA, 67 bp, Amsacta moorei entomopoxvirus
atgatattatcgatagttgtgataatgtgctcttttattttattaattgcgatgattataatattat

SEQ ID NO: 81185 - DNA, 24 bp, Amsacta moorei entomopoxvirus
tcgatagttgtgataatgtgctct

SEQ ID NO: 81186 - DNA, 18 bp, Homo sapiens
gtttagataatgtgctct

SEQ ID NO: 81187 - DNA, 21 bp, Homo sapiens
tcgacagtaagatgtgatgtg

SEQ ID NO: 81188 - DNA, 24 bp, Homo sapiens
tcggggttgtgccatctgtgctct

SEQ ID NO: 81189 - DNA, 18 bp, Homo sapiens
gatattgtgataaaaact

SEQ ID NO: 81190 - DNA, 23 bp, Homo sapiens
tctgtagttgcagggtgtgttct

SEQ ID NO: 81191 - DNA, 91 bp, Camelpox virus
taggaaattggtttataatgtataatttttttagtttttatagattctttattctatacttaaaaaatgaaaataaatacaaaggttcctg

SEQ ID NO: 81192 - DNA, 24 bp, Camelpox virus
tgaaaataaatacaaaggttcctg

SEQ ID NO: 81193 - DNA, 21 bp, Homo sapiens
tgaaataaatacaaaccagtt

SEQ ID NO: 81194 - DNA, 19 bp, Homo sapiens
tgaaaatacatacaaattc

SEQ ID NO: 81195 - DNA, 18 bp, Homo sapiens
tgatgataaatggttcct

SEQ ID NO: 81196 - DNA, 22 bp, Homo sapiens
tgaagataaaatacggtccctg

SEQ ID NO: 81197 - DNA, 21 bp, Homo sapiens
tgaaaataaatacagtccatg

SEQ ID NO: 81198 - DNA, 24 bp, Homo sapiens
tgaaaataatacagaaacagcctg

SEQ ID NO: 81199 - DNA, 23 bp, Homo sapiens
tgaaaatagtgcaagagcccctg

SEQ ID NO: 81200 - DNA, 22 bp, Homo sapiens
tgggaataaataagagtccctg

SEQ ID NO: 81201 - DNA, 23 bp, Homo sapiens
tgaacgtaaatacaataatcctg

SEQ ID NO: 81202 - DNA, 30 bp, Homo sapiens
tgggaacaaatatagataatcggttcctgc

SEQ ID NO: 81203 - DNA, 24 bp, Homo sapiens
aaaataaatgtccaatagttcctg

SEQ ID NO: 81204 - DNA, 21 bp, Homo sapiens
gaaaatgagtacaaatccctg

SEQ ID NO: 81205 - DNA, 18 bp, Homo sapiens
tgaaataaatacaaaaat

SEQ ID NO: 81206 - DNA, 20 bp, Homo sapiens
gaaacctacagaggttcctg

SEQ ID NO: 81207 - DNA, 18 bp, Homo sapiens
tgaaaatagacacaggct

SEQ ID NO: 81208 - DNA, 24 bp, Homo sapiens
tgaaaacctcattgagggttcctg

SEQ ID NO: 81209 - DNA, 21 bp, Homo sapiens
gaaaatagatacaaggaactg

SEQ ID NO: 81210 - DNA, 19 bp, Homo sapiens
taaaaataaatacactgtt

SEQ ID NO: 81211 - DNA, 19 bp, Homo sapiens
tggaaataaatacaagagt

SEQ ID NO: 81212 - DNA, 23 bp, Homo sapiens
tgaaataagtgtagcagttcctg

SEQ ID NO: 81213 - DNA, 19 bp, Homo sapiens
tgagaataaatacaacagg

SEQ ID NO: 81214 - DNA, 22 bp, Homo sapiens
tgaaaatatatacatatgcctg

SEQ ID NO: 81215 - DNA, 25 bp, Homo sapiens
tgaaaataaatatatgaataacctg

SEQ ID NO: 81216 - DNA, 19 bp, Homo sapiens
tgaaaataaggcaggacct

SEQ ID NO: 81217 - DNA, 19 bp, Homo sapiens
tgaaaataaatctatccct

SEQ ID NO: 81218 - DNA, 20 bp, Homo sapiens
gaaagaatataagattcctg

SEQ ID NO: 81219 - DNA, 25 bp, Homo sapiens
tgaaaatcaatacaaaaaaaaactg

SEQ ID NO: 81220 - DNA, 24 bp, Homo sapiens
tgaaaatatgtatgatgggtcctg

SEQ ID NO: 81221 - DNA, 20 bp, Homo sapiens
tgaaaaaaaatacaagagct

SEQ ID NO: 81222 - DNA, 85 bp, Human herpesvirus 3
tgttcagtctaaaaataatgttgggtatttataattaccgcccccgtgttacttggaaacacccatacatatgttccactctaca

SEQ ID NO: 81223 - DNA, 24 bp, Human herpesvirus 3
ttacttggaaacacccatacatat

SEQ ID NO: 81224 - DNA, 21 bp, Homo sapiens
ctacttagtacattcatacat

SEQ ID NO: 81225 - DNA, 25 bp, Homo sapiens
tcacttggaacatctttgtgcatat

SEQ ID NO: 81226 - DNA, 19 bp, Homo sapiens
ttacttgaaaatgcacata

SEQ ID NO: 81227 - DNA, 15 bp, Homo sapiens
cttggaaactacata

SEQ ID NO: 81228 - DNA, 30 bp, Homo sapiens
ttacttgaaaatattaacttcatacatata

SEQ ID NO: 81229 - DNA, 24 bp, Homo sapiens
ttacttgagaataccagttcatat

SEQ ID NO: 81230 - DNA, 21 bp, Homo sapiens
ttacttgggaacatcaaccat

SEQ ID NO: 81231 - DNA, 22 bp, Homo sapiens
ttacctggcacattatacatat

SEQ ID NO: 81232 - DNA, 16 bp, Homo sapiens
ttacttggacatgcat

SEQ ID NO: 81233 - DNA, 75 bp, Potato virus Y
tgctaagtttcagtttaaatcatttccttgcaattctctagaacaatattggaaaccatttcaactcaacaagca

SEQ ID NO: 81234 - DNA, 24 bp, Potato virus Y
taagtttcagtttaaatcatttcc

SEQ ID NO: 81235 - DNA, 21 bp, Homo sapiens
agtcttggcctggtcatttcc

SEQ ID NO: 81236 - DNA, 22 bp, Homo sapiens
taagtttccgttcctcatttcc

SEQ ID NO: 81237 - DNA, 23 bp, Homo sapiens
taagtttcagctctgccatttcc

SEQ ID NO: 81238 - DNA, 20 bp, Homo sapiens
aattccagtaaatcatttcc

SEQ ID NO: 81239 - DNA, 23 bp, Homo sapiens
aggttcaaacagagatcatttcc

SEQ ID NO: 81240 - DNA, 21 bp, Homo sapiens
gctttagtagctgtcatttcc

SEQ ID NO: 81241 - DNA, 21 bp, Homo sapiens
aggttcagttttcacatttcc

SEQ ID NO: 81242 - DNA, 16 bp, Homo sapiens
agtttcagtgccattt

SEQ ID NO: 81243 - DNA, 20 bp, Homo sapiens
agtttcagtttcctatttcc

SEQ ID NO: 81244 - DNA, 20 bp, Homo sapiens
tttcagtttgctcatgttcc

SEQ ID NO: 81245 - DNA, 18 bp, Homo sapiens
aatttcagtacttcattt

SEQ ID NO: 81246 - DNA, 23 bp, Homo sapiens
taaattccaactttaagtcattt

SEQ ID NO: 81247 - DNA, 20 bp, Homo sapiens
caagtttcagtttaagaatc

SEQ ID NO: 81248 - DNA, 20 bp, Homo sapiens
agcttcagtatttgtcattt

SEQ ID NO: 81249 - DNA, 21 bp, Homo sapiens
gttgttttttaaatcatttcc

SEQ ID NO: 81250 - DNA, 23 bp, Homo sapiens
aagtttcagaaagtgtcatttcc

SEQ ID NO: 81251 - DNA, 17 bp, Homo sapiens
aatttcaggctcatttc

SEQ ID NO: 81252 - DNA, 67 bp, African swine fever virus
ttaagtctattgttcatggcttaagtctattactcatagcttaactccattactgatcatgacttaa

SEQ ID NO: 81253 - DNA, 24 bp, African swine fever virus
tattgttcatggcttaagtctatt

SEQ ID NO: 81254 - DNA, 16 bp, Homo sapiens
tatagttcatggtcta

SEQ ID NO: 81255 - DNA, 74 bp, Acute bee paralysis virus
tcgcaacacaacatggttacccatagattgaggaaatttccaataaactcagtattaaggcttgttgtgttgga

SEQ ID NO: 81256 - DNA, 20 bp, Acute bee paralysis virus
ttaaggcttgttgtgttgga

SEQ ID NO: 81257 - DNA, 17 bp, Homo sapiens
ttaaggcaggtgttgga

SEQ ID NO: 81258 - DNA, 15 bp, Homo sapiens
aaggttggtgttgga

SEQ ID NO: 81259 - DNA, 19 bp, Homo sapiens
tcaaggcttgtactgtgga

SEQ ID NO: 81260 - DNA, 17 bp, Homo sapiens
ttaaggctcattttgga

SEQ ID NO: 81261 - DNA, 18 bp, Homo sapiens
tcaaggccaggctgttgg

SEQ ID NO: 81262 - DNA, 17 bp, Homo sapiens
ttaaggcttcttatagg

SEQ ID NO: 81263 - DNA, 16 bp, Homo sapiens
ttaaggcttggcttgg

SEQ ID NO: 81264 - DNA, 17 bp, Homo sapiens
ttaaggctgtttttgga

SEQ ID NO: 81265 - DNA, 17 bp, Homo sapiens
ttaaggcctgtcgagga

SEQ ID NO: 81266 - DNA, 15 bp, Homo sapiens
tcaaggcttatttgg

SEQ ID NO: 81267 - DNA, 16 bp, Homo sapiens
ttaaggctgacgtggg

SEQ ID NO: 81268 - DNA, 18 bp, Homo sapiens
aggccttgttgttgttgg

SEQ ID NO: 81269 - DNA, 19 bp, Homo sapiens
ttaagacttgagaactgga

SEQ ID NO: 81270 - DNA, 15 bp, Homo sapiens
tcaaggcttgcctgg

SEQ ID NO: 81271 - DNA, 20 bp, Homo sapiens
tcagggcttgtttgtccagg

SEQ ID NO: 81272 - DNA, 17 bp, Homo sapiens
taaggctgatgtgttgg

SEQ ID NO: 81273 - DNA, 15 bp, Homo sapiens
tcaaggccatgttgg

SEQ ID NO: 81274 - DNA, 18 bp, Homo sapiens
ctaaggcttgttggtgga

SEQ ID NO: 81275 - DNA, 18 bp, Homo sapiens
ttaagacttcagtttgga

SEQ ID NO: 81276 - DNA, 19 bp, Homo sapiens
tcaaggcagagtgtgttgg

SEQ ID NO: 81277 - DNA, 19 bp, Homo sapiens
tcaaggcttggggtcttgg

SEQ ID NO: 81278 - DNA, 17 bp, Homo sapiens
ttaaggcttctggtagg

SEQ ID NO: 81279 - DNA, 17 bp, Homo sapiens
aaggcttgttctctgga

SEQ ID NO: 81280 - DNA, 19 bp, Homo sapiens
ttagggcttgctccactag

SEQ ID NO: 81281 - DNA, 18 bp, Homo sapiens
ttaagtgttggagttgga

SEQ ID NO: 81282 - DNA, 20 bp, Homo sapiens
ttaaagcttgtttgcaatga

SEQ ID NO: 81283 - DNA, 19 bp, Homo sapiens
tcaaggcttgttgtcctga

SEQ ID NO: 81284 - DNA, 19 bp, Homo sapiens
aaagccatgttgtgttgga

SEQ ID NO: 81285 - DNA, 18 bp, Homo sapiens
aggttatttggtgttgga

SEQ ID NO: 81286 - DNA, 18 bp, Homo sapiens
ttaaggctctggctctgg

SEQ ID NO: 81287 - DNA, 18 bp, Homo sapiens
aggtcggactgtgttgga

SEQ ID NO: 81288 - DNA, 17 bp, Homo sapiens
ttaaggctggtcgatgg

SEQ ID NO: 81289 - DNA, 15 bp, Homo sapiens
tcaaggctatgttgg

SEQ ID NO: 81290 - DNA, 20 bp, Homo sapiens
ttaaggcttttaaatgtgga

SEQ ID NO: 81291 - DNA, 20 bp, Homo sapiens
ttagggcttgttcctgcagg

SEQ ID NO: 81292 - DNA, 20 bp, Homo sapiens
ttagggcttgttcctgcaga

SEQ ID NO: 81293 - DNA, 80 bp, Gallid herpesvirus 2
gtagcactcgaaatttcaaacggcatgtaaatacgaatgtccttagaaagcgacgtttagcggctggtgttcgatgtcac

SEQ ID NO: 81294 - DNA, 23 bp, Gallid herpesvirus 2
tagcggctggtgttcgatgtcac

SEQ ID NO: 81295 - DNA, 19 bp, Homo sapiens
tagcagctggtgttcagtc

SEQ ID NO: 81296 - DNA, 19 bp, Homo sapiens
acgtggttgtcgatgtcac

SEQ ID NO: 81297 - DNA, 23 bp, Homo sapiens
tagcgggtggacgctgatgtcac

SEQ ID NO: 81298 - DNA, 20 bp, Homo sapiens
cagcggctgctgggtgtcac

SEQ ID NO: 81299 - DNA, 16 bp, Homo sapiens
ggctgggtgacctcac

SEQ ID NO: 81300 - DNA, 21 bp, Homo sapiens
agtggcttttggtgatgtcac

SEQ ID NO: 81301 - DNA, 17 bp, Homo sapiens
ggttggtaacaatgtca

SEQ ID NO: 81302 - DNA, 17 bp, Homo sapiens
agtggctgatgatgtca

SEQ ID NO: 81303 - DNA, 19 bp, Homo sapiens
gcggctggggcagatgtca

SEQ ID NO: 81304 - DNA, 18 bp, Homo sapiens
tggttgctctgatgtcac

SEQ ID NO: 81305 - DNA, 87 bp, Monkeypox virus
gctgccatgtatttcctggagagcaagtagatgatgaggaaccagatagtttatatccatacttgcacttaaagtctacattgtagt

SEQ ID NO: 81306 - DNA, 24 bp, Monkeypox virus
agcaagtagatgatgaggaaccag

SEQ ID NO: 81307 - DNA, 17 bp, Homo sapiens
agaagtgtgtgaggaac

SEQ ID NO: 81308 - DNA, 18 bp, Homo sapiens
agcaagtagaatgggcca

SEQ ID NO: 81309 - DNA, 17 bp, Homo sapiens
agcaagtagatgtgcag

SEQ ID NO: 81310 - DNA, 21 bp, Homo sapiens
gcagctggatgctgggaccag

SEQ ID NO: 81311 - DNA, 22 bp, Homo sapiens
gcaggtaggtcggaagaatcag

SEQ ID NO: 81312 - DNA, 21 bp, Homo sapiens
acaggtggatgacaaggtcag

SEQ ID NO: 81313 - DNA, 22 bp, Homo sapiens
gcaaggggcagggaggaaccag

SEQ ID NO: 81314 - DNA, 23 bp, Homo sapiens
agcaggggatgagaagggatcag

SEQ ID NO: 81315 - DNA, 18 bp, Homo sapiens
agcgggtggatgatgagg

SEQ ID NO: 81316 - DNA, 20 bp, Homo sapiens
aagtggaaagcgggaaccag

SEQ ID NO: 81317 - DNA, 16 bp, Homo sapiens
agcaagcagaaggaac

SEQ ID NO: 81318 - DNA, 22 bp, Homo sapiens
agcggggacaaggaggaaccag

SEQ ID NO: 81319 - DNA, 21 bp, Homo sapiens
gtaggaagatgtaagaaccag

SEQ ID NO: 81320 - DNA, 21 bp, Homo sapiens
accggagagatgaggagccag

SEQ ID NO: 81321 - DNA, 18 bp, Homo sapiens
agacaggatgaggagcca

SEQ ID NO: 81322 - DNA, 18 bp, Homo sapiens
gcagatggggaggaacca

SEQ ID NO: 81323 - DNA, 19 bp, Homo sapiens
gtaggtggtgatgaggaac

SEQ ID NO: 81324 - DNA, 22 bp, Homo sapiens
agcaggactacagaggaaccag

SEQ ID NO: 81325 - DNA, 22 bp, Homo sapiens
gctggagacagagggggaccag

SEQ ID NO: 81326 - DNA, 17 bp, Homo sapiens
gcaggtgctgggaacca

SEQ ID NO: 81327 - DNA, 21 bp, Homo sapiens
agcaagtatggatggaaccag

SEQ ID NO: 81328 - DNA, 16 bp, Homo sapiens
agcaagagatgggcac

SEQ ID NO: 81329 - DNA, 17 bp, Homo sapiens
gcagcgtggggaaccag

SEQ ID NO: 81330 - DNA, 18 bp, Homo sapiens
agcgggtagtgatgaaaa

SEQ ID NO: 81331 - DNA, 15 bp, Homo sapiens
gcaagtgatgagacc

SEQ ID NO: 81332 - DNA, 21 bp, Homo sapiens
agcagtagatggacaaaccag

SEQ ID NO: 81333 - DNA, 19 bp, Homo sapiens
agtaagtgggaggaggcca

SEQ ID NO: 81334 - DNA, 23 bp, Homo sapiens
caagtagaaggacgaggggccag

SEQ ID NO: 81335 - DNA, 21 bp, Homo sapiens
gcaggaggagtgaggaaccag

SEQ ID NO: 81336 - DNA, 18 bp, Homo sapiens
gcaggcagccaggaacca

SEQ ID NO: 81337 - DNA, 18 bp, Homo sapiens
agtggcgtggggaaccag

SEQ ID NO: 81338 - DNA, 16 bp, Homo sapiens
gcaggtgaggaaccag

SEQ ID NO: 81339 - DNA, 22 bp, Homo sapiens
gcgagtcgcagaggggaaccag

SEQ ID NO: 81340 - DNA, 19 bp, Homo sapiens
agcaagtagagatttgcca

SEQ ID NO: 81341 - DNA, 19 bp, Homo sapiens
agcaagtaggtggtgtcag

SEQ ID NO: 81342 - DNA, 19 bp, Homo sapiens
aagtacctgactgaggaac

SEQ ID NO: 81343 - DNA, 20 bp, Homo sapiens
agcaagtaggtgtggaccaa

SEQ ID NO: 81344 - DNA, 22 bp, Homo sapiens
agcaagtagatcgatgttgaac

SEQ ID NO: 81345 - DNA, 16 bp, Homo sapiens
gcaatagatatgagga

SEQ ID NO: 81346 - DNA, 18 bp, Homo sapiens
caggtagatgatgccacc

SEQ ID NO: 81347 - DNA, 19 bp, Homo sapiens
gcaagtagaaggtgagcaa

SEQ ID NO: 81348 - DNA, 20 bp, Homo sapiens
agtgaatattgaatgaggaa

SEQ ID NO: 81349 - DNA, 22 bp, Homo sapiens
gcgaagagcggtggggaaccag

SEQ ID NO: 81350 - DNA, 23 bp, Homo sapiens
agcaagcaggtggtggtgatcag

SEQ ID NO: 81351 - DNA, 18 bp, Homo sapiens
gcaagtagaggtgaacaa

SEQ ID NO: 81352 - DNA, 21 bp, Homo sapiens
gcgggtggataacgaagtcag

SEQ ID NO: 81353 - DNA, 21 bp, Homo sapiens
gcagttggggtcaggaaccag

SEQ ID NO: 81354 - DNA, 60 bp, Meleagrid herpesvirus 1
tcagactgaggggcccttaggtttatatgaaatatattcttcgcgggtttaacagtttgg

SEQ ID NO: 81355 - DNA, 24 bp, Meleagrid herpesvirus 1
ttcttcgcgggtttaacagtttgg

SEQ ID NO: 81356 - DNA, 15 bp, Homo sapiens
gcgagaacagtttgg

SEQ ID NO: 81357 - DNA, 15 bp, Homo sapiens
gcaaaaacagtttgg

SEQ ID NO: 81358 - DNA, 24 bp, Homo sapiens
ttcttctttccaaagacagtttgg

SEQ ID NO: 81359 - DNA, 21 bp, Homo sapiens
ttctttcgaaacacagtttgg

SEQ ID NO: 81360 - DNA, 24 bp, Homo sapiens
ttcctgacttgtttaacagtttgg

SEQ ID NO: 81361 - DNA, 69 bp, Camelpox virus
tatatcgtagataagaatgtgataagatcgttggtggatcaacttccatatctacctatcttcgatata

SEQ ID NO: 81362 - DNA, 24 bp, Camelpox virus
tatcgtagataagaatgtgataag

SEQ ID NO: 81363 - DNA, 21 bp, Homo sapiens
gtagataagggaagagataag

SEQ ID NO: 81364 - DNA, 21 bp, Homo sapiens
tatcgtagatgaagacatcga

SEQ ID NO: 81365 - DNA, 60 bp, Fowlpox virus
atcactcaagattacttacttctattttaatgtatagattaaaaggttatttcgtatgat

SEQ ID NO: 81366 - DNA, 24 bp, Fowlpox virus
tcaagattacttacttctatttta

SEQ ID NO: 81367 - DNA, 20 bp, Homo sapiens
tccagattacttatcatttt

SEQ ID NO: 81368 - DNA, 20 bp, Homo sapiens
aaccacttatttctatttta

SEQ ID NO: 81369 - DNA, 25 bp, Homo sapiens
tcaagatttactttgtacttatttt

SEQ ID NO: 81370 - DNA, 23 bp, Homo sapiens
tcaagatcttatcttctatttta

SEQ ID NO: 81371 - DNA, 124 bp, Equine herpesvirus 2
tgaagacccgagagaagagctttacaaaaaacacaaaaaaacaaaaatttcaataaaaacaatttaaattttatttatctttgtatgtgtgtctcttgcaacccccaccccttatagatcttca

SEQ ID NO: 81372 - DNA, 24 bp, Equine herpesvirus 2
acaaaaatttcaataaaaacaatt

SEQ ID NO: 81373 - DNA, 22 bp, Homo sapiens
caaagcctccataaaaacaatt

SEQ ID NO: 81374 - DNA, 19 bp, Homo sapiens
acaaaaatttctcaacaat

SEQ ID NO: 81375 - DNA, 18 bp, Homo sapiens
acaaaagtttcaataaaa

SEQ ID NO: 81376 - DNA, 22 bp, Homo sapiens
acaaaaacttcactaaacaatt

SEQ ID NO: 81377 - DNA, 23 bp, Homo sapiens
acaagcatttcaaggaaacaatt

SEQ ID NO: 81378 - DNA, 20 bp, Homo sapiens
acaaaaatttcaacagaaca

SEQ ID NO: 81379 - DNA, 21 bp, Homo sapiens
acaaaaatttcaatatgcaat

SEQ ID NO: 81380 - DNA, 76 bp, Cymbidium mosaic virus
tcgtcctagctataggtataactgtggtctcagcattatttgtgctgaagtcccacacttttccaattgcaggcga

SEQ ID NO: 81381 - DNA, 24 bp, Cymbidium mosaic virus
tcccacacttttccaattgcaggc

SEQ ID NO: 81382 - DNA, 24 bp, Homo sapiens
tcccatttttcccttattgcaggc

SEQ ID NO: 81383 - DNA, 21 bp, Homo sapiens
ccttcacttccggttgcaggc

SEQ ID NO: 81384 - DNA, 16 bp, Homo sapiens
caacttttccagcaag

SEQ ID NO: 81385 - DNA, 20 bp, Homo sapiens
tcctttacttttccttaagg

SEQ ID NO: 81386 - DNA, 20 bp, Homo sapiens
tcccttacttttccttaagg

SEQ ID NO: 81387 - DNA, 16 bp, Homo sapiens
tcccccactattgcag

SEQ ID NO: 81388 - DNA, 15 bp, Homo sapiens
acactttattgcagg

SEQ ID NO: 81389 - DNA, 20 bp, Homo sapiens
tccccagccttgattgcagg

SEQ ID NO: 81390 - DNA, 22 bp, Homo sapiens
tcccaacttttcctagtcaggc

SEQ ID NO: 81391 - DNA, 21 bp, Homo sapiens
tcccacattttatcacaaggc

SEQ ID NO: 81392 - DNA, 19 bp, Homo sapiens
catcttttccagcacaagc

SEQ ID NO: 81393 - DNA, 19 bp, Homo sapiens
tcccatgtttttccaaaca

SEQ ID NO: 81394 - DNA, 20 bp, Homo sapiens
tcccattttgttttgcaggc

SEQ ID NO: 81395 - DNA, 18 bp, Homo sapiens
acattttcaattgcaggc

SEQ ID NO: 81396 - DNA, 21 bp, Homo sapiens
acactttttcatacaataggc

SEQ ID NO: 81397 - DNA, 19 bp, Homo sapiens
ccagcttttccagaagcgg

SEQ ID NO: 81398 - DNA, 19 bp, Homo sapiens
tcccactcttttcctgggc

SEQ ID NO: 81399 - DNA, 23 bp, Homo sapiens
tcccatttttttagttcacaggc

SEQ ID NO: 81400 - DNA, 20 bp, Homo sapiens
cacttttccacattgcaggc

SEQ ID NO: 81401 - DNA, 18 bp, Homo sapiens
tccctacaggattgcagg

SEQ ID NO: 81402 - DNA, 22 bp, Homo sapiens
tcctgacttcagctttgcaggc

SEQ ID NO: 81403 - DNA, 18 bp, Homo sapiens
tcccacactatatgcagg

SEQ ID NO: 81404 - DNA, 19 bp, Homo sapiens
cacgtcttctgattgcagg

SEQ ID NO: 81405 - DNA, 19 bp, Homo sapiens
tccccacttttctgaacag

SEQ ID NO: 81406 - DNA, 18 bp, Homo sapiens
tcccattcttttctcagg

SEQ ID NO: 81407 - DNA, 19 bp, Homo sapiens
cacacttttctctataagg

SEQ ID NO: 81408 - DNA, 18 bp, Homo sapiens
tcctacactttcttcagg

SEQ ID NO: 81409 - DNA, 21 bp, Homo sapiens
tcccaacttttctcccggggc

SEQ ID NO: 81410 - DNA, 21 bp, Homo sapiens
ccacatcccaacaattgcagg

SEQ ID NO: 81411 - DNA, 18 bp, Homo sapiens
cacacttttttgtgcaag

SEQ ID NO: 81412 - DNA, 21 bp, Homo sapiens
tctcacactttacccgcaggc

SEQ ID NO: 81413 - DNA, 17 bp, Homo sapiens
acttttccaagccaggc

SEQ ID NO: 81414 - DNA, 21 bp, Homo sapiens
ccacacttttatattttgggc

SEQ ID NO: 81415 - DNA, 19 bp, Homo sapiens
ccagcacttttccggaagg

SEQ ID NO: 81416 - DNA, 19 bp, Homo sapiens
cacctttccatcctccagg

SEQ ID NO: 81417 - DNA, 16 bp, Homo sapiens
cccacttttctgcagg

SEQ ID NO: 81418 - DNA, 19 bp, Homo sapiens
catatttccaattgcaggc

SEQ ID NO: 81419 - DNA, 21 bp, Homo sapiens
catactgccagaattgcaggc

SEQ ID NO: 81420 - DNA, 20 bp, Homo sapiens
cacactttattaaaagcagg

SEQ ID NO: 81421 - DNA, 18 bp, Homo sapiens
cacatatttttccaaagg

SEQ ID NO: 81422 - DNA, 19 bp, Homo sapiens
tcccacctttccctgcagg

SEQ ID NO: 81423 - DNA, 22 bp, Homo sapiens
tcccatacttttcacaattagc

SEQ ID NO: 81424 - DNA, 19 bp, Homo sapiens
tcccacatttctccatggc

SEQ ID NO: 81425 - DNA, 18 bp, Homo sapiens
actcatcccaattgtagg

SEQ ID NO: 81426 - DNA, 82 bp, Amsacta moorei entomopoxvirus
tgttaaaatatcaaatgttacaatagtttttttgttatcttcttttattaataaagccatattgtgtatattaattttaaca

SEQ ID NO: 81427 - DNA, 24 bp, Amsacta moorei entomopoxvirus
tatcaaatgttacaatagtttttt

SEQ ID NO: 81428 - DNA, 20 bp, Homo sapiens
tatcaaatgttaaaatggtt

SEQ ID NO: 81429 - DNA, 19 bp, Homo sapiens
tatcaatgttacagtagct

SEQ ID NO: 81430 - DNA, 19 bp, Homo sapiens
tatcaaatgttccagcttt

SEQ ID NO: 81431 - DNA, 21 bp, Homo sapiens
taccaaatgttaacatttttt

SEQ ID NO: 81432 - DNA, 17 bp, Homo sapiens
tatcaaatgtacaataa

SEQ ID NO: 81433 - DNA, 24 bp, Homo sapiens
catcaagtgttacaatgatttttt

SEQ ID NO: 81434 - DNA, 18 bp, Homo sapiens
tcaaatgtaacaatactt

SEQ ID NO: 81435 - DNA, 63 bp, Ateline herpesvirus 3
ctgtatacaagacaaaccaaaaatacaataaacgcgatatttaaacattttatttgtgtacag

SEQ ID NO: 81436 - DNA, 24 bp, Ateline herpesvirus 3
tacaagacaaaccaaaaatacaat

SEQ ID NO: 81437 - DNA, 21 bp, Homo sapiens
aagggcaaactgaaaatacaa

SEQ ID NO: 81438 - DNA, 18 bp, Homo sapiens
tacaaaacaaattaccaa

SEQ ID NO: 81439 - DNA, 21 bp, Homo sapiens
cacaagacagactgaaccaaa

SEQ ID NO: 81440 - DNA, 19 bp, Homo sapiens
aaacaaaccaaacagcaat

SEQ ID NO: 81441 - DNA, 18 bp, Homo sapiens
cacaagacagaccaaaaa

SEQ ID NO: 81442 - DNA, 21 bp, Homo sapiens
tacagatcacaaaaatacaat

SEQ ID NO: 81443 - DNA, 24 bp, Homo sapiens
tacaagaacagaccaaaacacaat

SEQ ID NO: 81444 - DNA, 17 bp, Homo sapiens
tacaaaacccaaaaata

SEQ ID NO: 81445 - DNA, 18 bp, Homo sapiens
acaaacagaaaaatacaa

SEQ ID NO: 81446 - DNA, 25 bp, Homo sapiens
tacaacacaaaccaacagctacaat

SEQ ID NO: 81447 - DNA, 16 bp, Homo sapiens
tacaaaacaaaataca

SEQ ID NO: 81448 - DNA, 28 bp, Homo sapiens
caagacaaactgtattggaaatacaata

SEQ ID NO: 81449 - DNA, 25 bp, Homo sapiens
tacaagacatactgggtcaaacaat

SEQ ID NO: 81450 - DNA, 20 bp, Homo sapiens
caggactcacagaaaataca

SEQ ID NO: 81451 - DNA, 22 bp, Homo sapiens
tacaaaacaaacaccctacaat

SEQ ID NO: 81452 - DNA, 20 bp, Homo sapiens
cacaagacagactagacaca

SEQ ID NO: 81453 - DNA, 22 bp, Homo sapiens
caagacaaattagaaaaacaat

SEQ ID NO: 81454 - DNA, 20 bp, Homo sapiens
agacaaaccagtattacaat

SEQ ID NO: 81455 - DNA, 65 bp, Tupaia herpesvirus
gccgagcacgccgccgcgatcggagacccagatctgcagggccgagtccgtggacggcggccggc

SEQ ID NO: 81456 - DNA, 19 bp, Tupaia herpesvirus
tccgtggacggcggccggc

SEQ ID NO: 81457 - DNA, 17 bp, Homo sapiens
tccgtgaaggcgttggc

SEQ ID NO: 81458 - DNA, 18 bp, Homo sapiens
tccgtggatgggaggggc

SEQ ID NO: 81459 - DNA, 18 bp, Homo sapiens
cgtggacgggaagctggc

SEQ ID NO: 81460 - DNA, 17 bp, Homo sapiens
ccactgcggcggccggc

SEQ ID NO: 81461 - DNA, 18 bp, Homo sapiens
tccgtggacggagtgtgg

SEQ ID NO: 81462 - DNA, 18 bp, Homo sapiens
tcggtcccggcggccggc

SEQ ID NO: 81463 - DNA, 18 bp, Homo sapiens
tccatgggagacagccgg

SEQ ID NO: 81464 - DNA, 16 bp, Homo sapiens
tccgagcggggctggc

SEQ ID NO: 81465 - DNA, 18 bp, Homo sapiens
tccggggacggcggcggc

SEQ ID NO: 81466 - DNA, 20 bp, Homo sapiens
tccatggacaggaaggctgg

SEQ ID NO: 81467 - DNA, 20 bp, Homo sapiens
tccgtagatgaagtactggc

SEQ ID NO: 81468 - DNA, 17 bp, Homo sapiens
tccgtggaggcgagggc

SEQ ID NO: 81469 - DNA, 19 bp, Homo sapiens
tccatggacgcgcagaggc

SEQ ID NO: 81470 - DNA, 18 bp, Homo sapiens
ccgctggtggcggccggc

SEQ ID NO: 81471 - DNA, 17 bp, Homo sapiens
cccggaccgcggccggc

SEQ ID NO: 81472 - DNA, 21 bp, Homo sapiens
tccggggacggcgcgcctggc

SEQ ID NO: 81473 - DNA, 17 bp, Homo sapiens
tccgcggacgcgtgggc

SEQ ID NO: 81474 - DNA, 16 bp, Homo sapiens
cccgccgcgcggccgg

SEQ ID NO: 81475 - DNA, 18 bp, Homo sapiens
tctgtggatgcaccaggc

SEQ ID NO: 81476 - DNA, 18 bp, Homo sapiens
tccatggagatgaccggc

SEQ ID NO: 81477 - DNA, 17 bp, Homo sapiens
ccctcagggcggccggc

SEQ ID NO: 81478 - DNA, 18 bp, Homo sapiens
tctatggacaacagtggc

SEQ ID NO: 81479 - DNA, 18 bp, Homo sapiens
tccctgccggcggccggc

SEQ ID NO: 81480 - DNA, 18 bp, Homo sapiens
tccgctggctcagccggc

SEQ ID NO: 81481 - DNA, 18 bp, Homo sapiens
cccgtggatggacagggg

SEQ ID NO: 81482 - DNA, 17 bp, Homo sapiens
tcctggctgcggccggc

SEQ ID NO: 81483 - DNA, 19 bp, Homo sapiens
cccgatgtgggcggccggc

SEQ ID NO: 81484 - DNA, 19 bp, Homo sapiens
ccgtggatgcgctcccggc

SEQ ID NO: 81485 - DNA, 16 bp, Homo sapiens
tccatggaggaaccgg

SEQ ID NO: 81486 - DNA, 16 bp, Homo sapiens
tcctgccgcggccggc

SEQ ID NO: 81487 - DNA, 16 bp, Homo sapiens
tccatggaagccctgg

SEQ ID NO: 81488 - DNA, 16 bp, Homo sapiens
tccggggcggccgagc

SEQ ID NO: 81489 - DNA, 20 bp, Homo sapiens
tccatggacttggagctggc

SEQ ID NO: 81490 - DNA, 17 bp, Homo sapiens
tccatggagccactggc

SEQ ID NO: 81491 - DNA, 16 bp, Homo sapiens
tccgtggatgagccgg

SEQ ID NO: 81492 - DNA, 18 bp, Homo sapiens
tccgggcaggcggccggc

SEQ ID NO: 81493 - DNA, 20 bp, Homo sapiens
tcctgggcggccgggccggc

SEQ ID NO: 81494 - DNA, 20 bp, Homo sapiens
tcagtggacaaacatttggc

SEQ ID NO: 81495 - DNA, 18 bp, Homo sapiens
cccggggacagcggcggc

SEQ ID NO: 81496 - DNA, 17 bp, Homo sapiens
cccgtggagtgcccggc

SEQ ID NO: 81497 - DNA, 19 bp, Homo sapiens
tccttgtagggcggccggc

SEQ ID NO: 81498 - DNA, 16 bp, Homo sapiens
tcctggggcagccggc

SEQ ID NO: 81499 - DNA, 19 bp, Homo sapiens
ccgtgagcaggcggccggc

SEQ ID NO: 81500 - DNA, 18 bp, Homo sapiens
cctgtgaacagggttggc

SEQ ID NO: 81501 - DNA, 15 bp, Homo sapiens
tccggggcggccggc

SEQ ID NO: 81502 - DNA, 16 bp, Homo sapiens
cccgggcgcggccggc

SEQ ID NO: 81503 - DNA, 20 bp, Homo sapiens
tcctggaacagcaggtcggc

SEQ ID NO: 81504 - DNA, 17 bp, Homo sapiens
tcggcgaggcggccggc

SEQ ID NO: 81505 - DNA, 21 bp, Homo sapiens
cccgtggaggcctgggccggc

SEQ ID NO: 81506 - DNA, 18 bp, Homo sapiens
cccgctcccgcggccggc

SEQ ID NO: 81507 - DNA, 16 bp, Homo sapiens
tccgggtacagccggc

SEQ ID NO: 81508 - DNA, 16 bp, Homo sapiens
tccgcggaactccggc

SEQ ID NO: 81509 - DNA, 16 bp, Homo sapiens
ccccggggcggccggc

SEQ ID NO: 81510 - DNA, 21 bp, Homo sapiens
tccgagggcggcgaccgcggc

SEQ ID NO: 81511 - DNA, 17 bp, Homo sapiens
tccgcggagaagccggc

SEQ ID NO: 81512 - DNA, 18 bp, Homo sapiens
cctgtggacggcagaggc

SEQ ID NO: 81513 - DNA, 20 bp, Homo sapiens
tccgtggagcggctgccggc

SEQ ID NO: 81514 - DNA, 18 bp, Homo sapiens
tccgcggagagacccggc

SEQ ID NO: 81515 - DNA, 15 bp, Homo sapiens
ccgggcgcggccggc

SEQ ID NO: 81516 - DNA, 17 bp, Homo sapiens
tccatggagctggctgg

SEQ ID NO: 81517 - DNA, 19 bp, Homo sapiens
cctggagctggcggccggc

SEQ ID NO: 81518 - DNA, 19 bp, Homo sapiens
ccgtggcctcgcggccggc

SEQ ID NO: 81519 - DNA, 18 bp, Homo sapiens
tcctggaggaatgccggc

SEQ ID NO: 81520 - DNA, 18 bp, Homo sapiens
tccctggaggcagctggc

SEQ ID NO: 81521 - DNA, 18 bp, Homo sapiens
cccgtggacgacacctgg

SEQ ID NO: 81522 - DNA, 15 bp, Homo sapiens
tcctggacaacacgg

SEQ ID NO: 81523 - DNA, 17 bp, Homo sapiens
tccgcggatgccccggc

SEQ ID NO: 81524 - DNA, 18 bp, Homo sapiens
tccgtagatgaacagggc

SEQ ID NO: 81525 - DNA, 16 bp, Homo sapiens
tccgcgggcggccagc

SEQ ID NO: 81526 - DNA, 17 bp, Homo sapiens
tccatggagcagctggc

SEQ ID NO: 81527 - DNA, 17 bp, Homo sapiens
tccgtggacgcggatgc

SEQ ID NO: 81528 - DNA, 19 bp, Homo sapiens
tccgcggagccgccccggc

SEQ ID NO: 81529 - DNA, 20 bp, Homo sapiens
cctatggtgcggcggccggc

SEQ ID NO: 81530 - DNA, 19 bp, Homo sapiens
ccgtattgcagcggccggc

SEQ ID NO: 81531 - DNA, 18 bp, Homo sapiens
tccgggaagccggccggc

SEQ ID NO: 81532 - DNA, 21 bp, Homo sapiens
tccctgacagcggtggccggc

SEQ ID NO: 81533 - DNA, 17 bp, Homo sapiens
cccgtggacgccagggc

SEQ ID NO: 81534 - DNA, 20 bp, Homo sapiens
tccgcggagatggcgccggc

SEQ ID NO: 81535 - DNA, 18 bp, Homo sapiens
tccctgccagcggccggc

SEQ ID NO: 81536 - DNA, 18 bp, Homo sapiens
tccgtgaaaccggccggc

SEQ ID NO: 81537 - DNA, 81 bp, Tupaia herpesvirus
cgggtcgcccctcgacgacgccgtcgccgacccgatccaaaatcgtaaatactgcgcgaccgcctcgtcgttccccacccg

SEQ ID NO: 81538 - DNA, 24 bp, Tupaia herpesvirus
tactgcgcgaccgcctcgtcgttc

SEQ ID NO: 81539 - DNA, 20 bp, Homo sapiens
tgtgcgaccgcctccggctc

SEQ ID NO: 81540 - DNA, 117 bp, Paramecium bursaria Chlorella virus 1
gagtacttattaagaatgacaaataacaaatgacaaatgacaaatgacaaatgacgattctaaaagtctatataagcattatttgccaattgtttttcactaaaatttaaagctctc

SEQ ID NO: 81541 - DNA, 24 bp, Paramecium bursaria Chlorella virus 1
tgacaaatgacaaatgacaaatga

SEQ ID NO: 81542 - DNA, 22 bp, Homo sapiens
tgacaaatgtcaggaagaaatg

SEQ ID NO: 81543 - DNA, 18 bp, Homo sapiens
tgacaaaggagcaaatga

SEQ ID NO: 81544 - DNA, 22 bp, Homo sapiens
tgacaaatgatctggtaaatga

SEQ ID NO: 81545 - DNA, 18 bp, Homo sapiens
caaatgacatgaaaagtg

SEQ ID NO: 81546 - DNA, 25 bp, Homo sapiens
tgagtaaatgacaaacacagaatga

SEQ ID NO: 81547 - DNA, 21 bp, Homo sapiens
taacaaatgatggccaaatga

SEQ ID NO: 81548 - DNA, 20 bp, Homo sapiens
gacagcatggatgacaaatg

SEQ ID NO: 81549 - DNA, 23 bp, Homo sapiens
tgaaaactactagtgacaaatga

SEQ ID NO: 81550 - DNA, 21 bp, Homo sapiens
atgataaatgacagataatga

SEQ ID NO: 81551 - DNA, 18 bp, Homo sapiens
tgaaacaaatgacaaatg

SEQ ID NO: 81552 - DNA, 22 bp, Homo sapiens
tgacaaatgaatttacaggtga

SEQ ID NO: 81553 - DNA, 22 bp, Homo sapiens
tgactaggtgacaaatgcaatg

SEQ ID NO: 81554 - DNA, 18 bp, Homo sapiens
atgacaaaccccagatga

SEQ ID NO: 81555 - DNA, 28 bp, Homo sapiens
tgacaaatggaaatgtattcataaatga

SEQ ID NO: 81556 - DNA, 21 bp, Homo sapiens
tgactgaatattgacaaatga

SEQ ID NO: 81557 - DNA, 17 bp, Homo sapiens
gataaatgtgacaaatg

SEQ ID NO: 81558 - DNA, 24 bp, Homo sapiens
tgacaaatgctacaatatggatga

SEQ ID NO: 81559 - DNA, 22 bp, Homo sapiens
tgacaaatggtgaatcacaatg

SEQ ID NO: 81560 - DNA, 22 bp, Homo sapiens
tgacaatggcatttacaaatga

SEQ ID NO: 81561 - DNA, 19 bp, Homo sapiens
tgacaaatgactgaatgca

SEQ ID NO: 81562 - DNA, 15 bp, Homo sapiens
aatgacaaacaaatg

SEQ ID NO: 81563 - DNA, 24 bp, Homo sapiens
tgacaaatgacagaattcaggtga

SEQ ID NO: 81564 - DNA, 22 bp, Homo sapiens
cacagtccaaggtgacaaatga

SEQ ID NO: 81565 - DNA, 23 bp, Homo sapiens
gacaaaggccaaatgacaggtga

SEQ ID NO: 81566 - DNA, 22 bp, Homo sapiens
acaaatgacaacacatgaatga

SEQ ID NO: 81567 - DNA, 131 bp, Bovine herpesvirus 1
ggcgtcgtcgtcgggccgggtgcgtcgccgttcgggccggacggtcggtgtctcgcgtttctaaaagagggctcgcactccggcgccgtgttcgcactgagaccggcattttatgttcgccggccccaccc

SEQ ID NO: 81568 - DNA, 24 bp, Bovine herpesvirus 1
ctcgcactccggcgccgtgttcgc

SEQ ID NO: 81569 - DNA, 18 bp, Homo sapiens
ctcgggctccggcgccgc

SEQ ID NO: 81570 - DNA, 19 bp, Homo sapiens
ctcgggctccggcgcgccg

SEQ ID NO: 81571 - DNA, 20 bp, Homo sapiens
ctcggcactctggtgcccgc

SEQ ID NO: 81572 - DNA, 21 bp, Homo sapiens
ctcgcgttcaggtgccgacgc

SEQ ID NO: 81573 - DNA, 21 bp, Homo sapiens
ctcgcactctcgagttgttcg

SEQ ID NO: 81574 - DNA, 21 bp, Homo sapiens
ctcacactctggtgccagcgt

SEQ ID NO: 81575 - DNA, 19 bp, Homo sapiens
ctcgcgttccgcgctcggc

SEQ ID NO: 81576 - DNA, 19 bp, Homo sapiens
ctcgcacaccggcgccggc

SEQ ID NO: 81577 - DNA, 28 bp, Homo sapiens
ctcgggctccggcgctggcgcgaacacg

SEQ ID NO: 81578 - DNA, 18 bp, Homo sapiens
ctcggctccggcgtgcgc

SEQ ID NO: 81579 - DNA, 22 bp, Homo sapiens
ctccacttcggacaatgttcgc

SEQ ID NO: 81580 - DNA, 23 bp, Homo sapiens
ctcgtgcatcggcgtctccatgc

SEQ ID NO: 81581 - DNA, 22 bp, Homo sapiens
ctcacactctggtagcattcgc

SEQ ID NO: 81582 - DNA, 18 bp, Homo sapiens
ctcgcgctctgccgccgc

SEQ ID NO: 81583 - DNA, 19 bp, Homo sapiens
ctcgccttcggctgcttcg

SEQ ID NO: 81584 - DNA, 19 bp, Homo sapiens
ctccactttggtgcatccg

SEQ ID NO: 81585 - DNA, 18 bp, Homo sapiens
ctcgtactctcggtgtca

SEQ ID NO: 81586 - DNA, 19 bp, Homo sapiens
ctcccactctgcgtgttcg

SEQ ID NO: 81587 - DNA, 19 bp, Homo sapiens
ctctgctccggcgtcccgt

SEQ ID NO: 81588 - DNA, 26 bp, Homo sapiens
ctcagcattctggcgctcactgatgc

SEQ ID NO: 81589 - DNA, 19 bp, Homo sapiens
ctcgcactccgcgctgttg

SEQ ID NO: 81590 - DNA, 94 bp, Gallid herpesvirus 3
gagttggctacaccgagatccggcatcataccttacgtgaactgcttacgtttggggatgtttttgcgtcggtgtttggggaggagtcaatctt

SEQ ID NO: 81591 - DNA, 24 bp, Gallid herpesvirus 3
caccgagatccggcatcatacctt

SEQ ID NO: 81592 - DNA, 21 bp, Homo sapiens
accgagatcggatcgtgcctt

SEQ ID NO: 81593 - DNA, 20 bp, Homo sapiens
actgagatccagcattcaca

SEQ ID NO: 81594 - DNA, 24 bp, Homo sapiens
caccagatgctagcatcatgcctt

SEQ ID NO: 81595 - DNA, 83 bp, Himetobi P virus
tttgtagttttaagattgaggttttttgacgctagccctatagtaggtaagctttttcctcataaatatttctttggcacaga

SEQ ID NO: 81596 - DNA, 24 bp, Himetobi P virus
taagctttttcctcataaatattt

SEQ ID NO: 81597 - DNA, 24 bp, Homo sapiens
taagtattttcttcataaatattt

SEQ ID NO: 81598 - DNA, 18 bp, Homo sapiens
ttcttcccccaaatattt

SEQ ID NO: 81599 - DNA, 22 bp, Homo sapiens
taagcttttttcttcaacattt

SEQ ID NO: 81600 - DNA, 25 bp, Homo sapiens
taagtttttctctcatggcacactt

SEQ ID NO: 81601 - DNA, 18 bp, Homo sapiens
taagcttttttttctcat

SEQ ID NO: 81602 - DNA, 87 bp, Equine herpesvirus 4
gctgtgggttatatgtttgcgattttccacaaagaacaataataactcttctggtcggagagttataagcataccgtgccccaaagt

SEQ ID NO: 81603 - DNA, 24 bp, Equine herpesvirus 4
tggtcggagagttataagcatacc

SEQ ID NO: 81604 - DNA, 21 bp, Homo sapiens
tggtggagagaaccaagtata

SEQ ID NO: 81605 - DNA, 22 bp, Homo sapiens
tggttgagagtcattttatacc

SEQ ID NO: 81606 - DNA, 22 bp, Homo sapiens
tggcactagtgttataagcata

SEQ ID NO: 81607 - DNA, 22 bp, Homo sapiens
tggtttgggagatgaagcatac

SEQ ID NO: 81608 - DNA, 24 bp, Homo sapiens
tggttagtcatttgtaagcatacc

SEQ ID NO: 81609 - DNA, 22 bp, Homo sapiens
tggtgggagagtttaacatacc

SEQ ID NO: 81610 - DNA, 61 bp, Monkeypox virus
gacttttatcacgttatctcatgtataaaatattacaaatagtatagcataaactaaagtc

SEQ ID NO: 81611 - DNA, 22 bp, Monkeypox virus
tagtatagcataaactaaagtc

SEQ ID NO: 81612 - DNA, 19 bp, Homo sapiens
tagtacttgaaactaaagt

SEQ ID NO: 81613 - DNA, 20 bp, Homo sapiens
agtatctttgaaactaaagt

SEQ ID NO: 81614 - DNA, 20 bp, Homo sapiens
cagtatagcatttcaaagtc

SEQ ID NO: 81615 - DNA, 19 bp, Homo sapiens
tagtacagcataaactaaa

SEQ ID NO: 81616 - DNA, 20 bp, Homo sapiens
atattcacacagctaaagtc

SEQ ID NO: 81617 - DNA, 17 bp, Homo sapiens
gtatagtaaccaaagtc

SEQ ID NO: 81618 - DNA, 20 bp, Homo sapiens
gcttagaaataaactaaagt

SEQ ID NO: 81619 - DNA, 21 bp, Homo sapiens
tagtatagcagaatactacag

SEQ ID NO: 81620 - DNA, 19 bp, Homo sapiens
cagtatagatattaaagtc

SEQ ID NO: 81621 - DNA, 16 bp, Homo sapiens
atatagcacctagagt

SEQ ID NO: 81622 - DNA, 21 bp, Homo sapiens
tagcatagtaattttaaagtc

SEQ ID NO: 81623 - DNA, 64 bp, Variola virus
ttgcatattatattttatattttatattttatattttgtaataagaatagaatgctaatgtcaa

SEQ ID NO: 81624 - DNA, 24 bp, Variola virus
tattatattttatattttatattt

SEQ ID NO: 81625 - DNA, 24 bp, Homo sapiens
tattatatttaacgtcttatattt

SEQ ID NO: 81626 - DNA, 131 bp, Vaccinia virus
gtgttcgagtgagttggattatgtgagtattggattgtatattttattttatattttatattttatattttgtaataagaataaaatgctaatgtcaagtttattccaatagatgtcttattaaaaaacat

SEQ ID NO: 81627 - DNA, 24 bp, Vaccinia virus
taataagaataaaatgctaatgtc

SEQ ID NO: 81628 - DNA, 17 bp, Homo sapiens
taataaaataaaatgcc

SEQ ID NO: 81629 - DNA, 21 bp, Homo sapiens
taatgagaataaaaagcaatg

SEQ ID NO: 81630 - DNA, 17 bp, Homo sapiens
taataagaatggatgcc

SEQ ID NO: 81631 - DNA, 19 bp, Homo sapiens
ataagaataaaactgtgtc

SEQ ID NO: 81632 - DNA, 131 bp, Sulfolobus virus SIRV-2
tttatttttttctttttaattttaatttattaattttctttttctatatttagctaattctatcaataatttttctcaatttctaaatattatttctaaaagttaaaaaatcagagagataaaaagataga

SEQ ID NO: 81633 - DNA, 21 bp, Sulfolobus virus SIRV-2
tcagagagataaaaagataga

SEQ ID NO: 81634 - DNA, 15 bp, Homo sapiens
ccagagagataagac

SEQ ID NO: 81635 - DNA, 15 bp, Homo sapiens
ccagagagatgacag

SEQ ID NO: 81636 - DNA, 19 bp, Homo sapiens
tcagagagaaaagcacaga

SEQ ID NO: 81637 - DNA, 18 bp, Homo sapiens
tcagaagataaatagcag

SEQ ID NO: 81638 - DNA, 19 bp, Homo sapiens
tcagagagagagaagtaga

SEQ ID NO: 81639 - DNA, 17 bp, Homo sapiens
cagagaggaaaagagag

SEQ ID NO: 81640 - DNA, 17 bp, Homo sapiens
cagagagaaaaggtaga

SEQ ID NO: 81641 - DNA, 18 bp, Homo sapiens
tcagaaagaaaaaggtag

SEQ ID NO: 81642 - DNA, 21 bp, Homo sapiens
ccagagagataacacacatag

SEQ ID NO: 81643 - DNA, 20 bp, Homo sapiens
agagggataaaaagtttaga

SEQ ID NO: 81644 - DNA, 18 bp, Homo sapiens
aaagagatgaaaaattag

SEQ ID NO: 81645 - DNA, 18 bp, Homo sapiens
tcagagagggaagccaga

SEQ ID NO: 81646 - DNA, 20 bp, Homo sapiens
aagaacaaggaaaagataga

SEQ ID NO: 81647 - DNA, 20 bp, Homo sapiens
agaaagataaggggaaatag

SEQ ID NO: 81648 - DNA, 17 bp, Homo sapiens
agagagatagagagaga

SEQ ID NO: 81649 - DNA, 20 bp, Homo sapiens
tcagagagtggaagggcaga

SEQ ID NO: 81650 - DNA, 16 bp, Homo sapiens
tcagagagattagata

SEQ ID NO: 81651 - DNA, 23 bp, Homo sapiens
tcagagagaaagaactaaggtag

SEQ ID NO: 81652 - DNA, 21 bp, Homo sapiens
tcaagagaaagtaaagataga

SEQ ID NO: 81653 - DNA, 18 bp, Homo sapiens
tcagagaggagaaaaaga

SEQ ID NO: 81654 - DNA, 21 bp, Homo sapiens
ccagaattctaaaaagatgga

SEQ ID NO: 81655 - DNA, 18 bp, Homo sapiens
cagagagataaccccaga

SEQ ID NO: 81656 - DNA, 22 bp, Homo sapiens
cagagagataactttgaataga

SEQ ID NO: 81657 - DNA, 20 bp, Homo sapiens
ccagaattataaaagataga

SEQ ID NO: 81658 - DNA, 16 bp, Homo sapiens
tcaagaaagaagatag

SEQ ID NO: 81659 - DNA, 20 bp, Homo sapiens
tcacggagataaaatacaga

SEQ ID NO: 81660 - DNA, 16 bp, Homo sapiens
ccagggagacaaagat

SEQ ID NO: 81661 - DNA, 20 bp, Homo sapiens
agacatgatgaaaagataga

SEQ ID NO: 81662 - DNA, 19 bp, Homo sapiens
tcagaaagatttaagatag

SEQ ID NO: 81663 - DNA, 21 bp, Homo sapiens
tcagagaagggtaaagatgga

SEQ ID NO: 81664 - DNA, 19 bp, Homo sapiens
ccagaaagtaagaaggtag

SEQ ID NO: 81665 - DNA, 21 bp, Homo sapiens
tcagagaaacaggaaggtaga

SEQ ID NO: 81666 - DNA, 20 bp, Homo sapiens
tcagaggataaaaagccaga

SEQ ID NO: 81667 - DNA, 19 bp, Homo sapiens
tcagagagaaaagtgcaga

SEQ ID NO: 81668 - DNA, 19 bp, Homo sapiens
tcagagagtatcacataga

SEQ ID NO: 81669 - DNA, 17 bp, Homo sapiens
aagaaacccaagataga

SEQ ID NO: 81670 - DNA, 20 bp, Homo sapiens
agagagatcaaactgagtag

SEQ ID NO: 81671 - DNA, 16 bp, Homo sapiens
agatgagaaagataga

SEQ ID NO: 81672 - DNA, 16 bp, Homo sapiens
tcaaagagatcaagat

SEQ ID NO: 81673 - DNA, 18 bp, Homo sapiens
gagagaaacaaagataga

SEQ ID NO: 81674 - DNA, 20 bp, Homo sapiens
gagagggtcaaaaagagaga

SEQ ID NO: 81675 - DNA, 20 bp, Homo sapiens
gaggattttggaaagataga

SEQ ID NO: 81676 - DNA, 16 bp, Homo sapiens
cagagagagaagatag

SEQ ID NO: 81677 - DNA, 18 bp, Homo sapiens
agagagacaaatccacag

SEQ ID NO: 81678 - DNA, 24 bp, Homo sapiens
tcagagaagggccccaaaaggtag

SEQ ID NO: 81679 - DNA, 18 bp, Homo sapiens
cagaaagagaaagataga

SEQ ID NO: 81680 - DNA, 18 bp, Homo sapiens
tcagggaggaaaaaacag

SEQ ID NO: 81681 - DNA, 16 bp, Homo sapiens
gagagagaaagataga

SEQ ID NO: 81682 - DNA, 22 bp, Homo sapiens
tcagagaaatctcaagagatag

SEQ ID NO: 81683 - DNA, 25 bp, Homo sapiens
ccagagaggatagcaagggggtaga

SEQ ID NO: 81684 - DNA, 19 bp, Homo sapiens
tcagagaatagaaaacaga

SEQ ID NO: 81685 - DNA, 24 bp, Homo sapiens
tcagagacataggacctcaataga

SEQ ID NO: 81686 - DNA, 25 bp, Homo sapiens
tcagaaagagacatagaaagataga

SEQ ID NO: 81687 - DNA, 18 bp, Homo sapiens
aggagatgggaagataga

SEQ ID NO: 81688 - DNA, 18 bp, Homo sapiens
agagaaactaagagatag

SEQ ID NO: 81689 - DNA, 18 bp, Homo sapiens
tcagcagaagaagataga

SEQ ID NO: 81690 - DNA, 17 bp, Homo sapiens
tcaaaaaaaaaaaagat

SEQ ID NO: 81691 - DNA, 21 bp, Homo sapiens
cagaggacagcagaagataga

SEQ ID NO: 81692 - DNA, 21 bp, Homo sapiens
tcagagaatggatatgaatag

SEQ ID NO: 81693 - DNA, 18 bp, Homo sapiens
ccagagaggaaaagggag

SEQ ID NO: 81694 - DNA, 18 bp, Homo sapiens
gagagataaagagatgga

SEQ ID NO: 81695 - DNA, 15 bp, Homo sapiens
ccagagagaagatag

SEQ ID NO: 81696 - DNA, 17 bp, Homo sapiens
gagaatagaaagataga

SEQ ID NO: 81697 - DNA, 19 bp, Homo sapiens
tcagagagaaagaaaaaga

SEQ ID NO: 81698 - DNA, 22 bp, Homo sapiens
ccagagagctgtgaagaggtag

SEQ ID NO: 81699 - DNA, 18 bp, Homo sapiens
tcagggagacaaaataga

SEQ ID NO: 81700 - DNA, 17 bp, Homo sapiens
tcagagagagaaaagat

SEQ ID NO: 81701 - DNA, 20 bp, Homo sapiens
gaacaagatagaaagataga

SEQ ID NO: 81702 - DNA, 74 bp, Equine herpesvirus 1
gtcggagagttataaacataccatgcaccaaagggtcagttttaaggggttttactttatgtgaattcaccgac

SEQ ID NO: 81703 - DNA, 24 bp, Equine herpesvirus 1
aaggggttttactttatgtgaatt

SEQ ID NO: 81704 - DNA, 18 bp, Homo sapiens
gggattttacttaataaa

SEQ ID NO: 81705 - DNA, 18 bp, Homo sapiens
aaggggttttgtttttgt

SEQ ID NO: 81706 - DNA, 19 bp, Homo sapiens
aaggagtctttgtgtgaat

SEQ ID NO: 81707 - DNA, 20 bp, Homo sapiens
aaggagttttatttcaaatg

SEQ ID NO: 81708 - DNA, 21 bp, Homo sapiens
aaggggttttgtgttggaatc

SEQ ID NO: 81709 - DNA, 23 bp, Homo sapiens
aaggtgtacctcttgtgtgaatt

SEQ ID NO: 81710 - DNA, 16 bp, Homo sapiens
gggttttgctcttgga

SEQ ID NO: 81711 - DNA, 22 bp, Homo sapiens
aaggggttcttgccttctgtga

SEQ ID NO: 81712 - DNA, 19 bp, Homo sapiens
aggagagcacttttatgtg

SEQ ID NO: 81713 - DNA, 21 bp, Homo sapiens
gggttttatttaaattgaatt

SEQ ID NO: 81714 - DNA, 22 bp, Homo sapiens
aagggattttcttgtgtgaatt

SEQ ID NO: 81715 - DNA, 16 bp, Homo sapiens
aggggctttattttgt

SEQ ID NO: 81716 - DNA, 22 bp, Homo sapiens
aaagggtttttcctctgtgtga

SEQ ID NO: 81717 - DNA, 18 bp, Homo sapiens
gggttttactggtgaatt

SEQ ID NO: 81718 - DNA, 16 bp, Homo sapiens
gggttttacttagaat

SEQ ID NO: 81719 - DNA, 16 bp, Homo sapiens
aagggattttacatga

SEQ ID NO: 81720 - DNA, 19 bp, Homo sapiens
aaggggtttttaactgaat

SEQ ID NO: 81721 - DNA, 19 bp, Homo sapiens
aagggttttgctttcttgt

SEQ ID NO: 81722 - DNA, 16 bp, Homo sapiens
agggtttcagcatgtg

SEQ ID NO: 81723 - DNA, 20 bp, Homo sapiens
aagggcttttctccagtgtg

SEQ ID NO: 81724 - DNA, 93 bp, Cowpea mottle virus
tgttgatcgcatattgctatttctgctcaacccaaagtgttagctacgttgtctctcactcagaacctgtagtaaatagtaaagttgtttaca

SEQ ID NO: 81725 - DNA, 24 bp, Cowpea mottle virus
tcgcatattgctatttctgctcaa

SEQ ID NO: 81726 - DNA, 18 bp, Homo sapiens
cattgcaggatttctgct

SEQ ID NO: 81727 - DNA, 15 bp, Homo sapiens
atattgctatactca

SEQ ID NO: 81728 - DNA, 22 bp, Homo sapiens
tctgtgtatcaccttctgctca

SEQ ID NO: 81729 - DNA, 16 bp, Homo sapiens
gctccctatttctgct

SEQ ID NO: 81730 - DNA, 17 bp, Homo sapiens
cattctgtttctgctca

SEQ ID NO: 81731 - DNA, 16 bp, Homo sapiens
gcatgtgttctgctca

SEQ ID NO: 81732 - DNA, 18 bp, Homo sapiens
gcatacttccaatctgct

SEQ ID NO: 81733 - DNA, 15 bp, Homo sapiens
gcattgatttctgct

SEQ ID NO: 81734 - DNA, 18 bp, Homo sapiens
tcttatgttgctatttcc

SEQ ID NO: 81735 - DNA, 15 bp, Homo sapiens
tcacatatttctgct

SEQ ID NO: 81736 - DNA, 17 bp, Homo sapiens
tcgtattgctataactc

SEQ ID NO: 81737 - DNA, 21 bp, Homo sapiens
gcatattgctatcatcttcaa

SEQ ID NO: 81738 - DNA, 17 bp, Homo sapiens
gcatttatttctgctca

SEQ ID NO: 81739 - DNA, 79 bp, African swine fever virus
atcaatttttagttttaaatatattggtacctaggacaaagaaagtatatatagccaataattattccactaaattgat

SEQ ID NO: 81740 - DNA, 24 bp, African swine fever virus
tatagccaataattattccactaa

SEQ ID NO: 81741 - DNA, 21 bp, Homo sapiens
catagccaagccttttcacta

SEQ ID NO: 81742 - DNA, 21 bp, Homo sapiens
taagccgataattataaacta

SEQ ID NO: 81743 - DNA, 19 bp, Homo sapiens
tatagatgacattccacta

SEQ ID NO: 81744 - DNA, 19 bp, Homo sapiens
tagccaggcattccactaa

SEQ ID NO: 81745 - DNA, 19 bp, Homo sapiens
agccaatagttattttact

SEQ ID NO: 81746 - DNA, 17 bp, Homo sapiens
tagccaatgatgtccct

SEQ ID NO: 81747 - DNA, 71 bp, Rat cytomegalovirus
ttacgtaataatgaccggatgtaattcgaacaaatcataaaacaccgatcccgttccgaaaatatacgtga

SEQ ID NO: 81748 - DNA, 24 bp, Rat cytomegalovirus
atcccgttccgaaaatatacgtga

SEQ ID NO: 81749 - DNA, 19 bp, Homo sapiens
gtccttgaaaatatacgtg

SEQ ID NO: 81750 - DNA, 21 bp, Homo sapiens
atcccgtctggatgcccgtga

SEQ ID NO: 81751 - DNA, 18 bp, Homo sapiens
atcccgttccgaacagtg

SEQ ID NO: 81752 - DNA, 18 bp, Homo sapiens
atcctgtttagaaaatac

SEQ ID NO: 81753 - DNA, 18 bp, Homo sapiens
gtcctgaaggacacgtga

SEQ ID NO: 81754 - DNA, 23 bp, Homo sapiens
atccttttcttgacgtatacgtg

SEQ ID NO: 81755 - DNA, 70 bp, Patchouli mild mosaic virus
tactactcttaaaacacatgtgtattgtgttaggttaaagcatcctttatatgtataagctttagtagta

SEQ ID NO: 81756 - DNA, 19 bp, Patchouli mild mosaic virus
tgtataagctttagtagta

SEQ ID NO: 81757 - DNA, 20 bp, Homo sapiens
tgaataagcttcacttagta

SEQ ID NO: 81758 - DNA, 18 bp, Homo sapiens
tgtagaagctctagatgt

SEQ ID NO: 81759 - DNA, 19 bp, Homo sapiens
tgttaagcttccagaagta

SEQ ID NO: 81760 - DNA, 19 bp, Homo sapiens
tgtacaggcttcaaatgta

SEQ ID NO: 81761 - DNA, 19 bp, Homo sapiens
taagctctttaaagtagta

SEQ ID NO: 81762 - DNA, 18 bp, Homo sapiens
tgcataagcttaacagta

SEQ ID NO: 81763 - DNA, 19 bp, Homo sapiens
tgcatagacaccagtagta

SEQ ID NO: 81764 - DNA, 18 bp, Homo sapiens
tgtattagctttaaagta

SEQ ID NO: 81765 - DNA, 18 bp, Homo sapiens
tgtaaagtgtcagtagta

SEQ ID NO: 81766 - DNA, 17 bp, Homo sapiens
tgtaaagctttaatgta

SEQ ID NO: 81767 - DNA, 15 bp, Homo sapiens
tgtataagccgcagt

SEQ ID NO: 81768 - DNA, 18 bp, Homo sapiens
tgtatggctttagtagta

SEQ ID NO: 81769 - DNA, 17 bp, Homo sapiens
tgtataggcctcaatgt

SEQ ID NO: 81770 - DNA, 17 bp, Homo sapiens
tgtaccttttagtagta

SEQ ID NO: 81771 - DNA, 17 bp, Homo sapiens
tgtataagcatgcaata

SEQ ID NO: 81772 - DNA, 20 bp, Homo sapiens
tataagctccaacagtagta

SEQ ID NO: 81773 - DNA, 18 bp, Homo sapiens
tgtaaaagcttagtagta

SEQ ID NO: 81774 - DNA, 15 bp, Homo sapiens
tgtatatttagtagt

SEQ ID NO: 81775 - DNA, 19 bp, Homo sapiens
tgtacaaagccacgtagta

SEQ ID NO: 81776 - DNA, 18 bp, Homo sapiens
tgtatgagcctcaatggt

SEQ ID NO: 81777 - DNA, 17 bp, Homo sapiens
tgtgagctccagcagta

SEQ ID NO: 81778 - DNA, 18 bp, Homo sapiens
tgtacaagctccctcagt

SEQ ID NO: 81779 - DNA, 18 bp, Homo sapiens
tgtaaagagtcagtagta

SEQ ID NO: 81780 - DNA, 18 bp, Homo sapiens
tgttaagctttatcagta

SEQ ID NO: 81781 - DNA, 18 bp, Homo sapiens
tgtaatgctgtagtagta

SEQ ID NO: 81782 - DNA, 18 bp, Homo sapiens
tgtgtaagctctgcagta

SEQ ID NO: 81783 - DNA, 19 bp, Homo sapiens
tgtagaagcaacaatagta

SEQ ID NO: 81784 - DNA, 18 bp, Homo sapiens
gtatgggctttagtacca

SEQ ID NO: 81785 - DNA, 60 bp, Rat cytomegalovirus
cctctttcgatttctacacgagaaaagttataaaatacatcagttagacgatcattgagg

SEQ ID NO: 81786 - DNA, 21 bp, Rat cytomegalovirus
tcagttagacgatcattgagg

SEQ ID NO: 81787 - DNA, 18 bp, Homo sapiens
tcagttaggcaatccctg

SEQ ID NO: 81788 - DNA, 20 bp, Homo sapiens
ccagttagatggttccacta

SEQ ID NO: 81789 - DNA, 21 bp, Homo sapiens
tctaatcagtgatcattgagg

SEQ ID NO: 81790 - DNA, 18 bp, Homo sapiens
tcagttagcaaactgagg

SEQ ID NO: 81791 - DNA, 16 bp, Homo sapiens
tcatttagacaatgag

SEQ ID NO: 81792 - DNA, 18 bp, Homo sapiens
tcagttagacaataaagg

SEQ ID NO: 81793 - DNA, 18 bp, Homo sapiens
tcagttaggagacaaagg

SEQ ID NO: 81794 - DNA, 21 bp, Homo sapiens
tcaattggtagttcattgagg

SEQ ID NO: 81795 - DNA, 20 bp, Homo sapiens
ccagttaggtggatcctggg

SEQ ID NO: 81796 - DNA, 19 bp, Homo sapiens
tcagttaatgtcagggagg

SEQ ID NO: 81797 - DNA, 23 bp, Homo sapiens
tcagttaatggtttttactgagg

SEQ ID NO: 81798 - DNA, 15 bp, Homo sapiens
ccagtagtcattgag

SEQ ID NO: 81799 - DNA, 22 bp, Homo sapiens
ccagttagatgatccaaacagg

SEQ ID NO: 81800 - DNA, 71 bp, Molluscum contagiosum virus
tcggaacgcgtgaggaggcggcactgctagcgacgcggacacattgcgaggcaccgcccgcccgcgctcga

SEQ ID NO: 81801 - DNA, 23 bp, Molluscum contagiosum virus
aggcaccgcccgcccgcgctcga

SEQ ID NO: 81802 - DNA, 20 bp, Homo sapiens
ggcaccgccccttcccctcg

SEQ ID NO: 81803 - DNA, 18 bp, Homo sapiens
ggggccgcccgcctgcgc

SEQ ID NO: 81804 - DNA, 19 bp, Homo sapiens
ggcaccgccccgcctctcg

SEQ ID NO: 81805 - DNA, 19 bp, Homo sapiens
ggcgctacccgcccgcccg

SEQ ID NO: 81806 - DNA, 18 bp, Homo sapiens
agctgccgcccgccgccg

SEQ ID NO: 81807 - DNA, 17 bp, Homo sapiens
aggcaccgccagccccg

SEQ ID NO: 81808 - DNA, 21 bp, Homo sapiens
gcgccgcccgccgccagctcg

SEQ ID NO: 81809 - DNA, 18 bp, Homo sapiens
ggcgcgacgacgcgctcg

SEQ ID NO: 81810 - DNA, 18 bp, Homo sapiens
aggcgccggccgcccgcg

SEQ ID NO: 81811 - DNA, 20 bp, Homo sapiens
ggcgccgcctcctgccccgc

SEQ ID NO: 81812 - DNA, 19 bp, Homo sapiens
ggccccgggccgcgctcga

SEQ ID NO: 81813 - DNA, 18 bp, Homo sapiens
agccgccgcccgctcgcg

SEQ ID NO: 81814 - DNA, 20 bp, Homo sapiens
ggtccggtctcccgcgctcg

SEQ ID NO: 81815 - DNA, 16 bp, Homo sapiens
ggcgcgcccgccgcct

SEQ ID NO: 81816 - DNA, 20 bp, Homo sapiens
ggtgcgcggcgccgcgctcg

SEQ ID NO: 81817 - DNA, 20 bp, Homo sapiens
aggcggtgccggcgcgctcg

SEQ ID NO: 81818 - DNA, 18 bp, Homo sapiens
ggcaccgcctccccgtca

SEQ ID NO: 81819 - DNA, 18 bp, Homo sapiens
aggcaccgtgtgcactcg

SEQ ID NO: 81820 - DNA, 20 bp, Homo sapiens
ggcatcgcccgcctttcccg

SEQ ID NO: 81821 - DNA, 22 bp, Homo sapiens
aggcgccgccgcccgcagccga

SEQ ID NO: 81822 - DNA, 19 bp, Homo sapiens
ggtcctgcccgccccaccc

SEQ ID NO: 81823 - DNA, 18 bp, Homo sapiens
ggggccgcccgcctcgct

SEQ ID NO: 81824 - DNA, 17 bp, Homo sapiens
gcgccgcccgccgacct

SEQ ID NO: 81825 - DNA, 19 bp, Homo sapiens
aggcaccagcttggcttcg

SEQ ID NO: 81826 - DNA, 21 bp, Homo sapiens
ggcgtccagcgcccgcgctcg

SEQ ID NO: 81827 - DNA, 19 bp, Homo sapiens
aggcgctgccctcccgccc

SEQ ID NO: 81828 - DNA, 22 bp, Homo sapiens
aggcaccgactgtgcagctgct

SEQ ID NO: 81829 - DNA, 17 bp, Homo sapiens
aggcaccgccgcctccg

SEQ ID NO: 81830 - DNA, 16 bp, Homo sapiens
ggcaccaccgcgctcg

SEQ ID NO: 81831 - DNA, 20 bp, Homo sapiens
gggcgctgggctgcgctcga

SEQ ID NO: 81832 - DNA, 19 bp, Homo sapiens
agacactgcctgcttccca

SEQ ID NO: 81833 - DNA, 19 bp, Homo sapiens
ggcggcctgctgcgctcga

SEQ ID NO: 81834 - DNA, 20 bp, Homo sapiens
ggcgccgcgcccgggctcga

SEQ ID NO: 81835 - DNA, 22 bp, Homo sapiens
aggcaccgcccccgggacctcg

SEQ ID NO: 81836 - DNA, 21 bp, Homo sapiens
gacgagtcctgcccgcgctcg

SEQ ID NO: 81837 - DNA, 17 bp, Homo sapiens
ggcgcggcgcgcgctcg

SEQ ID NO: 81838 - DNA, 19 bp, Homo sapiens
ggcatcgcccgccaccacg

SEQ ID NO: 81839 - DNA, 20 bp, Homo sapiens
ggccgccgccgccgcgctcg

SEQ ID NO: 81840 - DNA, 19 bp, Homo sapiens
ggcgcgcgcccgctctcga

SEQ ID NO: 81841 - DNA, 21 bp, Homo sapiens
aggcgtgagccaccgcgctcg

SEQ ID NO: 81842 - DNA, 18 bp, Homo sapiens
ggccgccgcccgctccca

SEQ ID NO: 81843 - DNA, 20 bp, Homo sapiens
ggccgctccggccccgcgct

SEQ ID NO: 81844 - DNA, 21 bp, Homo sapiens
agcctgcatcgcccgcgctcg

SEQ ID NO: 81845 - DNA, 22 bp, Homo sapiens
ggctccgcccgccccgagctcg

SEQ ID NO: 81846 - DNA, 20 bp, Homo sapiens
aggctccgcccgcctgcccg

SEQ ID NO: 81847 - DNA, 18 bp, Homo sapiens
agccgccgtccgcccacg

SEQ ID NO: 81848 - DNA, 22 bp, Homo sapiens
ggccgcgggaagcccgcgctcg

SEQ ID NO: 81849 - DNA, 19 bp, Homo sapiens
aggcaccgccagccgctcg

SEQ ID NO: 81850 - DNA, 24 bp, Homo sapiens
aggcaccgttgcttatgagcttga

SEQ ID NO: 81851 - DNA, 23 bp, Homo sapiens
gacaccgcggccacccgcgctcg

SEQ ID NO: 81852 - DNA, 22 bp, Homo sapiens
aggcaccgccttttagctgcga

SEQ ID NO: 81853 - DNA, 18 bp, Homo sapiens
agcgccgcttcgcgctcg

SEQ ID NO: 81854 - DNA, 21 bp, Homo sapiens
gacgccggggactcgcgctcg

SEQ ID NO: 81855 - DNA, 19 bp, Homo sapiens
ggcaccgctgcctccccga

SEQ ID NO: 81856 - DNA, 20 bp, Homo sapiens
agctaccgcccgccgggccg

SEQ ID NO: 81857 - DNA, 16 bp, Homo sapiens
ggcacgcccaggctcg

SEQ ID NO: 81858 - DNA, 16 bp, Homo sapiens
ggcacctccgccaccg

SEQ ID NO: 81859 - DNA, 18 bp, Homo sapiens
ggtccgcccgccgtcccg

SEQ ID NO: 81860 - DNA, 21 bp, Homo sapiens
aggcatcgccctccgcacccg

SEQ ID NO: 81861 - DNA, 20 bp, Homo sapiens
ggcgccgcgtcccgcgctcg

SEQ ID NO: 81862 - DNA, 16 bp, Homo sapiens
aggcactgcgcgctcg

SEQ ID NO: 81863 - DNA, 22 bp, Homo sapiens
ggcggggagccgcccgcgctcg

SEQ ID NO: 81864 - DNA, 21 bp, Homo sapiens
aggcccgctcgcccgcgctcg

SEQ ID NO: 81865 - DNA, 90 bp, Chimpanzee cytomegalovirus
gcgagccgcgtcgttcgcggacgcggcggtgggtccggccacagagcgacacgcggcccacgctgttcgtccgcgctcgtcgcagtccgc

SEQ ID NO: 81866 - DNA, 24 bp, Chimpanzee cytomegalovirus
cacgctgttcgtccgcgctcgtcg

SEQ ID NO: 81867 - DNA, 22 bp, Homo sapiens
cgcggtgggtgcgcgctcgtcg

SEQ ID NO: 81868 - DNA, 18 bp, Homo sapiens
cgctgtccaggcgcttgt

SEQ ID NO: 81869 - DNA, 21 bp, Homo sapiens
cgctgccctctccgcgctcgt

SEQ ID NO: 81870 - DNA, 63 bp, Human herpesvirus 5
tttgagccccaagcggtacggactacatattttccataaatctacactgaacttgagcacaaa

SEQ ID NO: 81871 - DNA, 21 bp, Human herpesvirus 5
tacactgaacttgagcacaaa

SEQ ID NO: 81872 - DNA, 21 bp, Homo sapiens
tacactaaataaaatacacaa

SEQ ID NO: 81873 - DNA, 20 bp, Homo sapiens
taccctgaacttatttggca

SEQ ID NO: 81874 - DNA, 18 bp, Homo sapiens
ccgattccttgagcacaa

SEQ ID NO: 81875 - DNA, 16 bp, Homo sapiens
tacactgatgatgcac

SEQ ID NO: 81876 - DNA, 22 bp, Homo sapiens
tacactgaaatgtactaacaaa

SEQ ID NO: 81877 - DNA, 19 bp, Homo sapiens
tacactgatcaccttcaca

SEQ ID NO: 81878 - DNA, 19 bp, Homo sapiens
tacactgagcctggcccca

SEQ ID NO: 81879 - DNA, 17 bp, Homo sapiens
cacacacatgagcacaa

SEQ ID NO: 81880 - DNA, 20 bp, Homo sapiens
tacaccgagtcactcacaaa

SEQ ID NO: 81881 - DNA, 18 bp, Homo sapiens
cacttgcctaagcacaaa

SEQ ID NO: 81882 - DNA, 18 bp, Homo sapiens
cacattgaacttgacaca

SEQ ID NO: 81883 - DNA, 19 bp, Homo sapiens
tacactgaccttcgccaaa

SEQ ID NO: 81884 - DNA, 20 bp, Homo sapiens
tacactgacactaatgctca

SEQ ID NO: 81885 - DNA, 18 bp, Homo sapiens
tacactgagactcaggca

SEQ ID NO: 81886 - DNA, 16 bp, Homo sapiens
tacagtgaaagcacaa

SEQ ID NO: 81887 - DNA, 19 bp, Homo sapiens
acactgaactaaatgtgca

SEQ ID NO: 81888 - DNA, 18 bp, Homo sapiens
taaactgctaagcacaaa

SEQ ID NO: 81889 - DNA, 18 bp, Homo sapiens
acactggcctgagcacaa

SEQ ID NO: 81890 - DNA, 16 bp, Homo sapiens
tacactaaaccacaca

SEQ ID NO: 81891 - DNA, 16 bp, Homo sapiens
tacctgaacagagaca

SEQ ID NO: 81892 - DNA, 18 bp, Homo sapiens
cacactgatgcaagcaca

SEQ ID NO: 81893 - DNA, 20 bp, Homo sapiens
tacactaaaaatggcacaaa

SEQ ID NO: 81894 - DNA, 18 bp, Homo sapiens
acacaagttgagcacaaa

SEQ ID NO: 81895 - DNA, 19 bp, Homo sapiens
tacacctgaactgggtgag

SEQ ID NO: 81896 - DNA, 19 bp, Homo sapiens
acactgaacagatcacaaa

SEQ ID NO: 81897 - DNA, 21 bp, Homo sapiens
tacactgaatgaaagtacaaa

SEQ ID NO: 81898 - DNA, 21 bp, Homo sapiens
tacaccgagtgataacacaaa

SEQ ID NO: 81899 - DNA, 17 bp, Homo sapiens
cactgatacagcacaaa

SEQ ID NO: 81900 - DNA, 19 bp, Homo sapiens
cacactgaactaggacaaa

SEQ ID NO: 81901 - DNA, 18 bp, Homo sapiens
ctgagccaaaagcacaaa

SEQ ID NO: 81902 - DNA, 15 bp, Homo sapiens
acactgaagacacaa

SEQ ID NO: 81903 - DNA, 18 bp, Homo sapiens
tacactgaggcttgatca

SEQ ID NO: 81904 - DNA, 20 bp, Homo sapiens
tacactgagtgtcacttaaa

SEQ ID NO: 81905 - DNA, 18 bp, Homo sapiens
tacactgaaagggcacaa

SEQ ID NO: 81906 - DNA, 20 bp, Homo sapiens
tacctgaactttatcacaaa

SEQ ID NO: 81907 - DNA, 21 bp, Homo sapiens
cacactgagaggctccacaaa

SEQ ID NO: 81908 - DNA, 19 bp, Homo sapiens
cactgaactttgcctcaaa

SEQ ID NO: 81909 - DNA, 21 bp, Homo sapiens
cacactgacaaaaagcacaaa

SEQ ID NO: 81910 - DNA, 17 bp, Homo sapiens
acactgaaacacacaaa

SEQ ID NO: 81911 - DNA, 17 bp, Homo sapiens
acactgaatcccacaaa

SEQ ID NO: 81912 - DNA, 17 bp, Homo sapiens
cactcactaagcacaaa

SEQ ID NO: 81913 - DNA, 19 bp, Homo sapiens
tgactgaaccactcacaaa

SEQ ID NO: 81914 - DNA, 18 bp, Homo sapiens
tacactaaactcatccac

SEQ ID NO: 81915 - DNA, 16 bp, Homo sapiens
cacactgaaaacacaa

SEQ ID NO: 81916 - DNA, 18 bp, Homo sapiens
tacactgaaaactacaaa

SEQ ID NO: 81917 - DNA, 18 bp, Homo sapiens
tacactgaatgacacaaa

SEQ ID NO: 81918 - DNA, 19 bp, Homo sapiens
actgaaccaatagcacaaa

SEQ ID NO: 81919 - DNA, 16 bp, Homo sapiens
actggaacagcacaaa

SEQ ID NO: 81920 - DNA, 15 bp, Homo sapiens
cactgaactggccaa

SEQ ID NO: 81921 - DNA, 18 bp, Homo sapiens
cattgaagggaacacaaa

SEQ ID NO: 81922 - DNA, 17 bp, Homo sapiens
cacactgaaaaacacaa

SEQ ID NO: 81923 - DNA, 16 bp, Homo sapiens
actgaactactacaaa

SEQ ID NO: 81924 - DNA, 19 bp, Homo sapiens
tacactgaagctaaacaca

SEQ ID NO: 81925 - DNA, 16 bp, Homo sapiens
tacctgatgagcacaa

SEQ ID NO: 81926 - DNA, 22 bp, Homo sapiens
tacactgaaattttatggcaca

SEQ ID NO: 81927 - DNA, 19 bp, Homo sapiens
cattgagtttaaacacaaa

SEQ ID NO: 81928 - DNA, 18 bp, Homo sapiens
taaacaactgagcacaaa

SEQ ID NO: 81929 - DNA, 20 bp, Homo sapiens
cattgaacttagttcacaaa

SEQ ID NO: 81930 - DNA, 17 bp, Homo sapiens
tgactgaactttagaca

SEQ ID NO: 81931 - DNA, 16 bp, Homo sapiens
cacactgaagacacaa

SEQ ID NO: 81932 - DNA, 16 bp, Homo sapiens
acactgaacttggcca

SEQ ID NO: 81933 - DNA, 19 bp, Homo sapiens
tacactgaacatgtcagca

SEQ ID NO: 81934 - DNA, 18 bp, Homo sapiens
tacgctgaaccccacaca

SEQ ID NO: 81935 - DNA, 17 bp, Homo sapiens
acactgaacacgacaca

SEQ ID NO: 81936 - DNA, 19 bp, Homo sapiens
acactgaaaagagagcaca

SEQ ID NO: 81937 - DNA, 20 bp, Homo sapiens
acgctgactcgtagcacaaa

SEQ ID NO: 81938 - DNA, 18 bp, Homo sapiens
tactctgaacttaatgca

SEQ ID NO: 81939 - DNA, 18 bp, Homo sapiens
actgaaacgtggcacaaa

SEQ ID NO: 81940 - DNA, 17 bp, Homo sapiens
cacacactgagcacaaa

SEQ ID NO: 81941 - DNA, 22 bp, Homo sapiens
tacacttgaacctatgtacaaa

SEQ ID NO: 81942 - DNA, 16 bp, Homo sapiens
taactgaacctcacaa

SEQ ID NO: 81943 - DNA, 18 bp, Homo sapiens
cacattgaacttaacaca

SEQ ID NO: 81944 - DNA, 18 bp, Homo sapiens
acactgaatcctcacaaa

SEQ ID NO: 81945 - DNA, 19 bp, Homo sapiens
acactgaactcaagcacaa

SEQ ID NO: 81946 - DNA, 20 bp, Homo sapiens
tacactgaaataattaacaa

SEQ ID NO: 81947 - DNA, 22 bp, Homo sapiens
tacactaattctgtaacacaaa

SEQ ID NO: 81948 - DNA, 18 bp, Homo sapiens
cactgggtgcagcacaaa

SEQ ID NO: 81949 - DNA, 18 bp, Homo sapiens
tacacttgaacaatgaca

SEQ ID NO: 81950 - DNA, 18 bp, Homo sapiens
acactgaacagcaacaaa

SEQ ID NO: 81951 - DNA, 85 bp, Horseradish curly top virus
accggttttataaagtaaagtaaagtagaccccactaggaaacttggtcggcaagtttaactttatccttttaaataaatacggt

SEQ ID NO: 81952 - DNA, 24 bp, Horseradish curly top virus
tataaagtaaagtaaagtagaccc

SEQ ID NO: 81953 - DNA, 20 bp, Homo sapiens
tataaagtagagcaaaaacc

SEQ ID NO: 81954 - DNA, 18 bp, Homo sapiens
taaagtcctcaaagtaga

SEQ ID NO: 81955 - DNA, 20 bp, Homo sapiens
tataaagtacaagtaagcaa

SEQ ID NO: 81956 - DNA, 19 bp, Homo sapiens
tataaagtgaaggcagacc

SEQ ID NO: 81957 - DNA, 18 bp, Homo sapiens
gttaagtaaagaaagacc

SEQ ID NO: 81958 - DNA, 24 bp, Homo sapiens
tataaaataagacttcatagaccc

SEQ ID NO: 81959 - DNA, 20 bp, Homo sapiens
agtaaagccatcatggaccc

SEQ ID NO: 81960 - DNA, 19 bp, Homo sapiens
tatggagcaaagtgcagcc

SEQ ID NO: 81961 - DNA, 20 bp, Homo sapiens
gtgaagtaaagataacaccc

SEQ ID NO: 81962 - DNA, 20 bp, Homo sapiens
ataaagtaagtcggtaggcc

SEQ ID NO: 81963 - DNA, 18 bp, Homo sapiens
tataaagtagagcaatgt

SEQ ID NO: 81964 - DNA, 92 bp, Infectious hematopoietic necrosis virus
aggtggcacttcagttgtaacctgataacgtgctttagacactataaaccgagacagaacaagcagaactattttcactgaaaaccacacct

SEQ ID NO: 81965 - DNA, 24 bp, Infectious hematopoietic necrosis virus
acagaacaagcagaactattttca

SEQ ID NO: 81966 - DNA, 18 bp, Homo sapiens
agaacaagggaaacattt

SEQ ID NO: 81967 - DNA, 24 bp, Homo sapiens
acagaaacaagctattcattttca

SEQ ID NO: 81968 - DNA, 22 bp, Homo sapiens
acagaacaaggaggaatcattt

SEQ ID NO: 81969 - DNA, 20 bp, Homo sapiens
agaacacactgctattttca

SEQ ID NO: 81970 - DNA, 20 bp, Homo sapiens
caaaacctcacagctatttt

SEQ ID NO: 81971 - DNA, 20 bp, Homo sapiens
cagaacaaagtagaacatct

SEQ ID NO: 81972 - DNA, 16 bp, Homo sapiens
agaacaagcaatattt

SEQ ID NO: 81973 - DNA, 20 bp, Homo sapiens
cagaacaatcagcaatttca

SEQ ID NO: 81974 - DNA, 20 bp, Homo sapiens
acagataagcagaacacctt

SEQ ID NO: 81975 - DNA, 27 bp, Homo sapiens
acagaatacagcagacccagtttttca

SEQ ID NO: 81976 - DNA, 23 bp, Homo sapiens
acagaaaaagtagaaaggtttca

SEQ ID NO: 81977 - DNA, 19 bp, Homo sapiens
acagaacaagtgaattctc

SEQ ID NO: 81978 - DNA, 17 bp, Homo sapiens
agaacagcattattttc

SEQ ID NO: 81979 - DNA, 19 bp, Homo sapiens
agaacaaggaggacatctt

SEQ ID NO: 81980 - DNA, 21 bp, Homo sapiens
acatagcatcaactattttca

SEQ ID NO: 81981 - DNA, 21 bp, Homo sapiens
acagaagagcagtaagtttca

SEQ ID NO: 81982 - DNA, 21 bp, Homo sapiens
acaaagcatttactattttca

SEQ ID NO: 81983 - DNA, 19 bp, Homo sapiens
acaggacaagcagcagcta

SEQ ID NO: 81984 - DNA, 18 bp, Homo sapiens
acagaacaggaagaacca

SEQ ID NO: 81985 - DNA, 17 bp, Homo sapiens
acagaacaatggaacca

SEQ ID NO: 81986 - DNA, 22 bp, Homo sapiens
agaacaaggagaaattgtttca

SEQ ID NO: 81987 - DNA, 22 bp, Homo sapiens
acaggagaagagactattttca

SEQ ID NO: 81988 - DNA, 22 bp, Homo sapiens
acagaactgagaaatattttca

SEQ ID NO: 81989 - DNA, 21 bp, Homo sapiens
cagagcagggatttattttca

SEQ ID NO: 81990 - DNA, 19 bp, Homo sapiens
cagggcaagcagaagcact

SEQ ID NO: 81991 - DNA, 19 bp, Homo sapiens
aaacaagcaggactttcca

SEQ ID NO: 81992 - DNA, 21 bp, Homo sapiens
acagaaaagcagcccgtttca

SEQ ID NO: 81993 - DNA, 22 bp, Homo sapiens
acagagtgtagcaccattttca

SEQ ID NO: 81994 - DNA, 23 bp, Homo sapiens
acaaataagcagttttattttca

SEQ ID NO: 81995 - DNA, 24 bp, Homo sapiens
acaaaacatcaaaaactattttca

SEQ ID NO: 81996 - DNA, 18 bp, Homo sapiens
gaacaagcaggattccca

SEQ ID NO: 81997 - DNA, 17 bp, Homo sapiens
gaacaacagactatttt

SEQ ID NO: 81998 - DNA, 18 bp, Homo sapiens
cagcaacaggccattttc

SEQ ID NO: 81999 - DNA, 23 bp, Homo sapiens
cagataagatgaagctattttca

SEQ ID NO: 82000 - DNA, 19 bp, Homo sapiens
acacaacaaggatattttc

SEQ ID NO: 82001 - DNA, 19 bp, Homo sapiens
agaaaagcagctattttca

SEQ ID NO: 82002 - DNA, 21 bp, Homo sapiens
acagaacaagcagcgaattca

SEQ ID NO: 82003 - DNA, 22 bp, Homo sapiens
cagaacaagtgggtcatatttt

SEQ ID NO: 82004 - DNA, 20 bp, Homo sapiens
cagaacaagagaacagtttt

SEQ ID NO: 82005 - DNA, 18 bp, Homo sapiens
gaagaataagcagaacca

SEQ ID NO: 82006 - DNA, 22 bp, Homo sapiens
acagaacaacagggctgtttca

SEQ ID NO: 82007 - DNA, 19 bp, Homo sapiens
agacaagcagtcattttca

SEQ ID NO: 82008 - DNA, 20 bp, Homo sapiens
agaacaagtagaacacattt

SEQ ID NO: 82009 - DNA, 21 bp, Homo sapiens
acaagagcaagtctattttca

SEQ ID NO: 82010 - DNA, 19 bp, Homo sapiens
gaacaagcagtgcttttca

SEQ ID NO: 82011 - DNA, 22 bp, Homo sapiens
acaaagcaaggagctctatttt

SEQ ID NO: 82012 - DNA, 18 bp, Homo sapiens
acgaaacaagcagttttc

SEQ ID NO: 82013 - DNA, 19 bp, Homo sapiens
acagacacaggatattttc

SEQ ID NO: 82014 - DNA, 19 bp, Homo sapiens
acagaacaacgtaggacca

SEQ ID NO: 82015 - DNA, 23 bp, Homo sapiens
gaagaacaagcaggtgttatttt

SEQ ID NO: 82016 - DNA, 20 bp, Homo sapiens
caaggtgttaactattttca

SEQ ID NO: 82017 - DNA, 21 bp, Homo sapiens
agaataaaataactattttca

SEQ ID NO: 82018 - DNA, 18 bp, Homo sapiens
gaaaagcagaagcacttt

SEQ ID NO: 82019 - DNA, 23 bp, Homo sapiens
acagaacaggcaggccaagttca

SEQ ID NO: 82020 - DNA, 18 bp, Homo sapiens
caggaacaggccattttc

SEQ ID NO: 82021 - DNA, 17 bp, Homo sapiens
aaacaagctttattttc

SEQ ID NO: 82022 - DNA, 23 bp, Homo sapiens
acagaacaggacagggattttca

SEQ ID NO: 82023 - DNA, 130 bp, Melanoplus sanguinipes entomopoxvirus
ttatttcattatttgcattggtaatacttattgtaattttatttaaattatcagtattaggactaataaccaatactaatgataattatagtagtgatgaatccgattaaaaaataatgaaaattaatag

SEQ ID NO: 82024 - DNA, 24 bp, Melanoplus sanguinipes entomopoxvirus
gcattggtaatacttattgtaatt

SEQ ID NO: 82025 - DNA, 18 bp, Homo sapiens
gcattggcaatacttatt

SEQ ID NO: 82026 - DNA, 21 bp, Homo sapiens
gcattgggcacaattgtaatt

SEQ ID NO: 82027 - DNA, 18 bp, Homo sapiens
gcattggtaataaatact

SEQ ID NO: 82028 - DNA, 20 bp, Homo sapiens
gcgttggcaatgtttaatgt

SEQ ID NO: 82029 - DNA, 64 bp, Potato leafroll virus
aacgtctagcattcccgagaaattgcagctttagcgcataaactctacactcattgcaaacgtt

SEQ ID NO: 82030 - DNA, 24 bp, Potato leafroll virus
tagcattcccgagaaattgcagct

SEQ ID NO: 82031 - DNA, 22 bp, Homo sapiens
gccattctcaatccttgcagct

SEQ ID NO: 82032 - DNA, 18 bp, Homo sapiens
gcattcccaggaatatac

SEQ ID NO: 82033 - DNA, 19 bp, Homo sapiens
gcattccctggaagaaatc

SEQ ID NO: 82034 - DNA, 17 bp, Homo sapiens
tagcattcctagaaact

SEQ ID NO: 82035 - DNA, 18 bp, Homo sapiens
tagcacttgaattgcagc

SEQ ID NO: 82036 - DNA, 21 bp, Homo sapiens
tagcattcccagaaaacaact

SEQ ID NO: 82037 - DNA, 24 bp, Homo sapiens
tagcaccaatggggagttgcagct

SEQ ID NO: 82038 - DNA, 17 bp, Homo sapiens
ttcccgagaagccaact

SEQ ID NO: 82039 - DNA, 23 bp, Homo sapiens
tagcagtttctgagcccacagct

SEQ ID NO: 82040 - DNA, 20 bp, Homo sapiens
gcttctcggcatctgcagct

SEQ ID NO: 82041 - DNA, 20 bp, Homo sapiens
tagcatcctgggaggcatcg

SEQ ID NO: 82042 - DNA, 16 bp, Homo sapiens
attcccgagccgcggc

SEQ ID NO: 82043 - DNA, 123 bp, Tupaia herpesvirus
gacctaatacgggtactgtctataaactcgatgcgcgacagatcatgtagacggtcccacgtaaactaatcacgtgcataaaaccatatatatcgagtaggtagacgacacccgcctcacgtc

SEQ ID NO: 82044 - DNA, 24 bp, Tupaia herpesvirus
actgtctataaactcgatgcgcga

SEQ ID NO: 82045 - DNA, 21 bp, Homo sapiens
tatctatagatgcgagcgtga

SEQ ID NO: 82046 - DNA, 19 bp, Homo sapiens
tgttcataaactcagctga

SEQ ID NO: 82047 - DNA, 18 bp, Homo sapiens
actgtctaggactcattg

SEQ ID NO: 82048 - DNA, 19 bp, Homo sapiens
actggttataaactttatg

SEQ ID NO: 82049 - DNA, 23 bp, Homo sapiens
ctgctataaacagtcatgtgcga

SEQ ID NO: 82050 - DNA, 18 bp, Homo sapiens
actgtccataaattcatg

SEQ ID NO: 82051 - DNA, 20 bp, Homo sapiens
actttctataaaccgtcccg

SEQ ID NO: 82052 - DNA, 18 bp, Homo sapiens
actgtctaaagatggaca

SEQ ID NO: 82053 - DNA, 105 bp, Rabbit fibroma virus
gaggttcatgacaaaattcctactgtattatgtacgatggattttaactagcacatgattcattagtatcgtactcgtttttcgtagagacatgttatgtacctt

SEQ ID NO: 82054 - DNA, 24 bp, Rabbit fibroma virus
ttcatgacaaaattcctactgtat

SEQ ID NO: 82055 - DNA, 18 bp, Homo sapiens
ttctgacaaaattctgca

SEQ ID NO: 82056 - DNA, 18 bp, Homo sapiens
gacaaatccgtactgtat

SEQ ID NO: 82057 - DNA, 25 bp, Homo sapiens
tccatgacagggttccgcgccctgt

SEQ ID NO: 82058 - DNA, 15 bp, Homo sapiens
atgacaaaatctgca

SEQ ID NO: 82059 - DNA, 18 bp, Homo sapiens
gacaaggtctcactgtat

SEQ ID NO: 82060 - DNA, 19 bp, Homo sapiens
ttcatggagctcctactgt

SEQ ID NO: 82061 - DNA, 20 bp, Homo sapiens
ttcatgtgaaattcctcagt

SEQ ID NO: 82062 - DNA, 77 bp, Bovine papillomavirus
tattgctgtttgtaagttttttactagagtttgtattccccctgctcagattttatatggtttaagctgcagcaata

SEQ ID NO: 82063 - DNA, 24 bp, Bovine papillomavirus
ttgctgtttgtaagttttttacta

SEQ ID NO: 82064 - DNA, 23 bp, Homo sapiens
ctgctgttttatttatttttact

SEQ ID NO: 82065 - DNA, 23 bp, Homo sapiens
ttgtttttgtttgttttttacta

SEQ ID NO: 82066 - DNA, 21 bp, Homo sapiens
ttcctgtttgtctgattttta

SEQ ID NO: 82067 - DNA, 18 bp, Homo sapiens
ctgttttttttttttact

SEQ ID NO: 82068 - DNA, 21 bp, Homo sapiens
tgttttgtattttttttacta

SEQ ID NO: 82069 - DNA, 15 bp, Homo sapiens
ttgctgtttttttac

SEQ ID NO: 82070 - DNA, 66 bp, Mumps virus
gccagaacaagcttaggatcacaatacaacacagaaccccagctgctatcataactgttctctggc

SEQ ID NO: 82071 - DNA, 24 bp, Mumps virus
accccagctgctatcataactgtt

SEQ ID NO: 82072 - DNA, 22 bp, Homo sapiens
ccgtggctggtcattaactgtt

SEQ ID NO: 82073 - DNA, 20 bp, Homo sapiens
cctcagctactgtttctgtt

SEQ ID NO: 82074 - DNA, 20 bp, Homo sapiens
cccgggctgctaccgctgtt

SEQ ID NO: 82075 - DNA, 21 bp, Homo sapiens
gccagccatcttgtaactgtt

SEQ ID NO: 82076 - DNA, 19 bp, Homo sapiens
cccagctgctgcgtctgct

SEQ ID NO: 82077 - DNA, 17 bp, Homo sapiens
ccactagctataactgt

SEQ ID NO: 82078 - DNA, 18 bp, Homo sapiens
gctccttcctcaactgtt

SEQ ID NO: 82079 - DNA, 16 bp, Homo sapiens
caggcacataactgtt

SEQ ID NO: 82080 - DNA, 18 bp, Homo sapiens
cagtgtcccataactgtt

SEQ ID NO: 82081 - DNA, 20 bp, Homo sapiens
ccccagctgctgtctgcact

SEQ ID NO: 82082 - DNA, 21 bp, Homo sapiens
accccaactgcacaggctgtt

SEQ ID NO: 82083 - DNA, 20 bp, Homo sapiens
ccagctgccagcaagctgtt

SEQ ID NO: 82084 - DNA, 21 bp, Homo sapiens
cctaagctgtctataactgtt

SEQ ID NO: 82085 - DNA, 20 bp, Homo sapiens
ccctattctatgtaactgtt

SEQ ID NO: 82086 - DNA, 20 bp, Homo sapiens
cctagtactgagtaactgtt

SEQ ID NO: 82087 - DNA, 21 bp, Homo sapiens
actccagctgctggcactgcc

SEQ ID NO: 82088 - DNA, 18 bp, Homo sapiens
accccagctgcgagctgt

SEQ ID NO: 82089 - DNA, 18 bp, Homo sapiens
cattgctatcacacagtt

SEQ ID NO: 82090 - DNA, 17 bp, Homo sapiens
cccagctgtccagctgt

SEQ ID NO: 82091 - DNA, 22 bp, Homo sapiens
accacagctgctaagagctgtt

SEQ ID NO: 82092 - DNA, 87 bp, Cercopithecine herpesvirus 7
tgtttttatttactattcgcgtcatcacattatcctaaccaaaaatacatttatttgctgttagatgacattggtacatataatcca

SEQ ID NO: 82093 - DNA, 22 bp, Cercopithecine herpesvirus 7
tgacattggtacatataatcca

SEQ ID NO: 82094 - DNA, 18 bp, Homo sapiens
acaagtatacatataatc

SEQ ID NO: 82095 - DNA, 19 bp, Homo sapiens
cactggaacatataattca

SEQ ID NO: 82096 - DNA, 17 bp, Homo sapiens
taactagtatataatcc

SEQ ID NO: 82097 - DNA, 23 bp, Homo sapiens
tggcattggtagtaaaatatcca

SEQ ID NO: 82098 - DNA, 15 bp, Homo sapiens
attgatacaaatcca

SEQ ID NO: 82099 - DNA, 21 bp, Homo sapiens
tgacattggagacaaggatcc

SEQ ID NO: 82100 - DNA, 22 bp, Homo sapiens
taacacaataacatataattca

SEQ ID NO: 82101 - DNA, 22 bp, Homo sapiens
tgacattggtaacccgtctcca

SEQ ID NO: 82102 - DNA, 18 bp, Homo sapiens
tgcattaacactataatc

SEQ ID NO: 82103 - DNA, 20 bp, Homo sapiens
acaggttgatatataatcca

SEQ ID NO: 82104 - DNA, 16 bp, Homo sapiens
acatgatatataatcc

SEQ ID NO: 82105 - DNA, 20 bp, Homo sapiens
tgacattgtgtgcatgctcc

SEQ ID NO: 82106 - DNA, 19 bp, Homo sapiens
taacaagtcatataatcca

SEQ ID NO: 82107 - DNA, 19 bp, Homo sapiens
caattatacatataatcca

SEQ ID NO: 82108 - DNA, 15 bp, Homo sapiens
gacattggtacatcc

SEQ ID NO: 82109 - DNA, 20 bp, Homo sapiens
tgtacatttactataatcca

SEQ ID NO: 82110 - DNA, 22 bp, Homo sapiens
tgacactggtgtaataaatcca

SEQ ID NO: 82111 - DNA, 17 bp, Homo sapiens
tgactgaaatataatcc

SEQ ID NO: 82112 - DNA, 22 bp, Homo sapiens
tgacattgtaaattataatcca

SEQ ID NO: 82113 - DNA, 20 bp, Homo sapiens
tgacattagtacaagcagtc

SEQ ID NO: 82114 - DNA, 22 bp, Homo sapiens
tgacaatggtacatatatccca

SEQ ID NO: 82115 - DNA, 19 bp, Homo sapiens
tggcattggtacatgttcc

SEQ ID NO: 82116 - DNA, 21 bp, Homo sapiens
catgttggtacaggtactcca

SEQ ID NO: 82117 - DNA, 16 bp, Homo sapiens
acattggtataatacc

SEQ ID NO: 82118 - DNA, 19 bp, Homo sapiens
gacattgaacactatgatc

SEQ ID NO: 82119 - DNA, 16 bp, Homo sapiens
attggtacagacacca

SEQ ID NO: 82120 - DNA, 20 bp, Homo sapiens
actgatcagtatataatcca

SEQ ID NO: 82121 - DNA, 19 bp, Homo sapiens
taacattggtacaagtctc

SEQ ID NO: 82122 - DNA, 18 bp, Homo sapiens
tggctcacgtataatcca

SEQ ID NO: 82123 - DNA, 16 bp, Homo sapiens
cataggatataatcca

SEQ ID NO: 82124 - DNA, 103 bp, Camelpox virus
aatgctgaatgctgaagctgtatacactcaagttgataacggtaactctttctggtaggaagctacgttattgggagatgtaacacaatgcgcatttagaatt

SEQ ID NO: 82125 - DNA, 24 bp, Camelpox virus
tgtaacacaatgcgcatttagaat

SEQ ID NO: 82126 - DNA, 19 bp, Homo sapiens
tgtaaacattcatttagaa

SEQ ID NO: 82127 - DNA, 19 bp, Homo sapiens
acacaatgcaaattagaat

SEQ ID NO: 82128 - DNA, 18 bp, Homo sapiens
tgtaacacagtgacaaga

SEQ ID NO: 82129 - DNA, 23 bp, Homo sapiens
tgcaacacttctatatttagaat

SEQ ID NO: 82130 - DNA, 23 bp, Homo sapiens
tgtgacccaaaacaatttagaat

SEQ ID NO: 82131 - DNA, 17 bp, Homo sapiens
gtaacacatgatttaga

SEQ ID NO: 82132 - DNA, 22 bp, Homo sapiens
tgcaatataccacatttagaat

SEQ ID NO: 82133 - DNA, 23 bp, Homo sapiens
tggaacacaataacattgtttag

SEQ ID NO: 82134 - DNA, 64 bp, Ictalurid herpesvirus 1
gggaggctcttaaccatcaaaacttcgtgactggcgtcccgaggagcgccccacggatcctccc

SEQ ID NO: 82135 - DNA, 24 bp, Ictalurid herpesvirus 1
gctcttaaccatcaaaacttcgtg

SEQ ID NO: 82136 - DNA, 19 bp, Homo sapiens
gctttaatgaaaacttcgt

SEQ ID NO: 82137 - DNA, 18 bp, Homo sapiens
gctcttaatcttactcgt

SEQ ID NO: 82138 - DNA, 18 bp, Homo sapiens
gctttcaatcatcaaaac

SEQ ID NO: 82139 - DNA, 69 bp, Camelpox virus
tgcaatattgttatcgtaattggaaaattagtgttcgagtgagtcggattatgtgagtactggattgca

SEQ ID NO: 82140 - DNA, 24 bp, Camelpox virus
tgagtcggattatgtgagtactgg

SEQ ID NO: 82141 - DNA, 25 bp, Homo sapiens
tgggtcagtaccaggtgggtgctgg

SEQ ID NO: 82142 - DNA, 17 bp, Homo sapiens
tgagtcgggtatgtgaa

SEQ ID NO: 82143 - DNA, 98 bp, Cowpox virus
attgtatattttattttatattttatattttgtagtaagaatagaatgctaatgacaagtttattacaatagatgtcttattaaaaaacatatataat

SEQ ID NO: 82144 - DNA, 24 bp, Cowpox virus
tattttattttatattttatattt

SEQ ID NO: 82145 - DNA, 24 bp, Homo sapiens
ttctattttatatccactatattt

SEQ ID NO: 82146 - DNA, 18 bp, Homo sapiens
ttttattttatattctat

SEQ ID NO: 82147 - DNA, 23 bp, Homo sapiens
tattttatttacattttatattt

SEQ ID NO: 82148 - DNA, 20 bp, Homo sapiens
cattttattttacattatat

SEQ ID NO: 82149 - DNA, 91 bp, Lymphocystis disease virus 1
gtaattcaatagctgtgaattataaagtgcaatactgtaagcgaatttctattatcgctggctttattacactttataattcatgaattat

SEQ ID NO: 82150 - DNA, 24 bp, Lymphocystis disease virus 1
taaagtgcaatactgtaagcgaat

SEQ ID NO: 82151 - DNA, 21 bp, Homo sapiens
taaagtgcagattgtaaagca

SEQ ID NO: 82152 - DNA, 16 bp, Homo sapiens
aagtgcaatgccgcga

SEQ ID NO: 82153 - DNA, 17 bp, Homo sapiens
gtgagccgcaagcgaat

SEQ ID NO: 82154 - DNA, 70 bp, Chimpanzee cytomegalovirus
ccctgtctgatcccgaaagctgctaggttctcttataaccgtatgccctagctgacgtgggtactcgggg

SEQ ID NO: 82155 - DNA, 24 bp, Chimpanzee cytomegalovirus
tgccctagctgacgtgggtactcg

SEQ ID NO: 82156 - DNA, 20 bp, Homo sapiens
tgccttagctgacttaaaat

SEQ ID NO: 82157 - DNA, 18 bp, Homo sapiens
tgtcccagctgacgtggg

SEQ ID NO: 82158 - DNA, 21 bp, Homo sapiens
tgccctagttcgtgtggaact

SEQ ID NO: 82159 - DNA, 19 bp, Homo sapiens
cttacttaaaacgggtact

SEQ ID NO: 82160 - DNA, 17 bp, Homo sapiens
tgcccagctactcaggt

SEQ ID NO: 82161 - DNA, 23 bp, Homo sapiens
tgtccttgcccgttgggtactcg

SEQ ID NO: 82162 - DNA, 19 bp, Homo sapiens
tgtcctagtgatggacact

SEQ ID NO: 82163 - DNA, 17 bp, Homo sapiens
gccgcgacgtgggtact

SEQ ID NO: 82164 - DNA, 17 bp, Homo sapiens
gctgcagctacgtgggt

SEQ ID NO: 82165 - DNA, 20 bp, Homo sapiens
tgccttagctgacttcaaat

SEQ ID NO: 82166 - DNA, 18 bp, Homo sapiens
tgccctagctgggtgggt

SEQ ID NO: 82167 - DNA, 127 bp, Human herpesvirus 6
ggtttccggaattggtcgaagatataaataggatcttggtagatgcttggggcaggaaacctaaaatcgtgctgaacgcgtctttctttataaagtggctctcgtcgacaataagcagattgaagct

SEQ ID NO: 82168 - DNA, 24 bp, Human herpesvirus 6
tcgaagatataaataggatcttgg

SEQ ID NO: 82169 - DNA, 17 bp, Homo sapiens
gaagatagaaaaccttg

SEQ ID NO: 82170 - DNA, 23 bp, Homo sapiens
gaagacataaacattcttcttgg

SEQ ID NO: 82171 - DNA, 20 bp, Homo sapiens
gaagaatgagtagaatctgg

SEQ ID NO: 82172 - DNA, 19 bp, Homo sapiens
gaagattttcagatcttgg

SEQ ID NO: 82173 - DNA, 17 bp, Homo sapiens
gaagatccaggatcttg

SEQ ID NO: 82174 - DNA, 22 bp, Homo sapiens
gaaaatataaactcgtttttgg

SEQ ID NO: 82175 - DNA, 70 bp, Human herpesvirus 6
ctttctttataaagtggctctcgtcgacaataagcagattgaagctctgtccgcgtatactctgagaggg

SEQ ID NO: 82176 - DNA, 24 bp, Human herpesvirus 6
tataaagtggctctcgtcgacaat

SEQ ID NO: 82177 - DNA, 19 bp, Homo sapiens
ataaagtggcttttgtgga

SEQ ID NO: 82178 - DNA, 17 bp, Homo sapiens
aggggctctccaacaat

SEQ ID NO: 82179 - DNA, 21 bp, Homo sapiens
aaatggcttttgcaaaacaat

SEQ ID NO: 82180 - DNA, 18 bp, Homo sapiens
taaagtggcccaagaaca

SEQ ID NO: 82181 - DNA, 19 bp, Homo sapiens
tatagaatggctctacaca

SEQ ID NO: 82182 - DNA, 69 bp, Human herpesvirus 5
tggtgtgtgtctatatatattggtcactgattttttttacaataaagagatagacatcacagttcacca

SEQ ID NO: 82183 - DNA, 24 bp, Human herpesvirus 5
agagatagacatcacagttcacca

SEQ ID NO: 82184 - DNA, 18 bp, Homo sapiens
agaagtaacatcacagtt

SEQ ID NO: 82185 - DNA, 17 bp, Homo sapiens
cagatcacagttcatca

SEQ ID NO: 82186 - DNA, 22 bp, Homo sapiens
agacatggacatcaggaaatca

SEQ ID NO: 82187 - DNA, 24 bp, Homo sapiens
gagatagatagtcacagttcccca

SEQ ID NO: 82188 - DNA, 22 bp, Homo sapiens
agagatagacagtatttcagct

SEQ ID NO: 82189 - DNA, 23 bp, Homo sapiens
agagacagacattgaaactgcca

SEQ ID NO: 82190 - DNA, 17 bp, Homo sapiens
agagacagacacaagtt

SEQ ID NO: 82191 - DNA, 19 bp, Homo sapiens
agagaaggtgacagttcac

SEQ ID NO: 82192 - DNA, 19 bp, Homo sapiens
agagagacaggcagttcac

SEQ ID NO: 82193 - DNA, 26 bp, Homo sapiens
agggacagacattgcagtaaatacca

SEQ ID NO: 82194 - DNA, 19 bp, Homo sapiens
agaacagtacatcacagtt

SEQ ID NO: 82195 - DNA, 19 bp, Homo sapiens
agagataagcatcgctccc

SEQ ID NO: 82196 - DNA, 21 bp, Homo sapiens
agagaagacatcacctcccca

SEQ ID NO: 82197 - DNA, 19 bp, Homo sapiens
agagatagactttacattc

SEQ ID NO: 82198 - DNA, 20 bp, Homo sapiens
gagacagatctggtttacca

SEQ ID NO: 82199 - DNA, 23 bp, Homo sapiens
agagatagaccttgcatctacca

SEQ ID NO: 82200 - DNA, 21 bp, Homo sapiens
agagacagtattcccgcagtt

SEQ ID NO: 82201 - DNA, 21 bp, Homo sapiens
agagatagatgcacctaatca

SEQ ID NO: 82202 - DNA, 22 bp, Homo sapiens
agggatagatgtcaccatgtca

SEQ ID NO: 82203 - DNA, 21 bp, Homo sapiens
agacagtatcttacagttcac

SEQ ID NO: 82204 - DNA, 18 bp, Homo sapiens
agggatagacagcacagt

SEQ ID NO: 82205 - DNA, 23 bp, Homo sapiens
agggatgcggacgcagttcacca

SEQ ID NO: 82206 - DNA, 18 bp, Homo sapiens
aggtagacatcattttca

SEQ ID NO: 82207 - DNA, 23 bp, Homo sapiens
agagataggtactgaacaaacca

SEQ ID NO: 82208 - DNA, 21 bp, Homo sapiens
gagttggaggtcggttcacca

SEQ ID NO: 82209 - DNA, 18 bp, Homo sapiens
gagatagaatcatcctcc

SEQ ID NO: 82210 - DNA, 19 bp, Homo sapiens
gagaggacattacaatcca

SEQ ID NO: 82211 - DNA, 15 bp, Homo sapiens
agaaataccacagtt

SEQ ID NO: 82212 - DNA, 20 bp, Homo sapiens
agagatagagatggcacgtt

SEQ ID NO: 82213 - DNA, 22 bp, Homo sapiens
agcagatgactgaacggttcac

SEQ ID NO: 82214 - DNA, 19 bp, Homo sapiens
agaaatagacattgaagcc

SEQ ID NO: 82215 - DNA, 19 bp, Homo sapiens
agagatagactttgcctcc

SEQ ID NO: 82216 - DNA, 16 bp, Homo sapiens
agagatagaaaattca

SEQ ID NO: 82217 - DNA, 18 bp, Homo sapiens
agagataacatcacaatt

SEQ ID NO: 82218 - DNA, 24 bp, Homo sapiens
agaggagtcacaggcagttcacca

SEQ ID NO: 82219 - DNA, 23 bp, Homo sapiens
aagatggacacagccagttcacc

SEQ ID NO: 82220 - DNA, 18 bp, Homo sapiens
gagagaatcacagttcac

SEQ ID NO: 82221 - DNA, 19 bp, Homo sapiens
agagggggacatcactccc

SEQ ID NO: 82222 - DNA, 19 bp, Homo sapiens
agaggaggtatcacccacc

SEQ ID NO: 82223 - DNA, 16 bp, Homo sapiens
gagaggacatcacgct

SEQ ID NO: 82224 - DNA, 18 bp, Homo sapiens
agagaaaggcatcaaatc

SEQ ID NO: 82225 - DNA, 23 bp, Homo sapiens
aggataggataacaagttcacca

SEQ ID NO: 82226 - DNA, 18 bp, Homo sapiens
agagaagacattacatca

SEQ ID NO: 82227 - DNA, 16 bp, Homo sapiens
gaaatagatatctcac

SEQ ID NO: 82228 - DNA, 18 bp, Homo sapiens
agagaaaggcatcaagtc

SEQ ID NO: 82229 - DNA, 17 bp, Homo sapiens
gagatagttaattcacc

SEQ ID NO: 82230 - DNA, 18 bp, Homo sapiens
gagatggacatcaccgcc

SEQ ID NO: 82231 - DNA, 131 bp, Impatiens necrotic spot virus
acaactagtgtgcatacactaattttcgacaagtaactcgcacatctttagaattttcgattctaaaaagtcgaataacactagttctaaaattgctttatgagtttgatctgttgtatgtagatttttgt

SEQ ID NO: 82232 - DNA, 24 bp, Impatiens necrotic spot virus
tagtgtgcatacactaattttcga

SEQ ID NO: 82233 - DNA, 18 bp, Homo sapiens
cagtgtgtgtacactaac

SEQ ID NO: 82234 - DNA, 19 bp, Homo sapiens
tagtgtgcacacataactt

SEQ ID NO: 82235 - DNA, 21 bp, Homo sapiens
gtgtacattcaaaatttttga

SEQ ID NO: 82236 - DNA, 79 bp, Human herpesvirus 1
ggttcccctgattaggctacgagtcgcggtgatcgcttcccaaaaaccgagctgcgtttgtctgtcttggtcttccacc

SEQ ID NO: 82237 - DNA, 17 bp, Human herpesvirus 1
tgtcttggtcttccacc

SEQ ID NO: 82238 - DNA, 19 bp, Homo sapiens
tgtacttgaagcccccacc

SEQ ID NO: 82239 - DNA, 18 bp, Homo sapiens
tgtcttggtcttccaccg

SEQ ID NO: 82240 - DNA, 20 bp, Homo sapiens
tgccttaatttcctttcacc

SEQ ID NO: 82241 - DNA, 18 bp, Homo sapiens
tgccttggtctggtcacc

SEQ ID NO: 82242 - DNA, 18 bp, Homo sapiens
tgtcctgccgagcccacc

SEQ ID NO: 82243 - DNA, 18 bp, Homo sapiens
tgccagcccctttccacc

SEQ ID NO: 82244 - DNA, 18 bp, Homo sapiens
tgccccgagtcttctacc

SEQ ID NO: 82245 - DNA, 18 bp, Homo sapiens
tgctagtccctttccacc

SEQ ID NO: 82246 - DNA, 19 bp, Homo sapiens
tgccttggccaaagccacc

SEQ ID NO: 82247 - DNA, 19 bp, Homo sapiens
tgtctggccctcttccacc

SEQ ID NO: 82248 - DNA, 18 bp, Homo sapiens
gtcttgactatttccacc

SEQ ID NO: 82249 - DNA, 20 bp, Homo sapiens
tgtcctaggccctcttccac

SEQ ID NO: 82250 - DNA, 19 bp, Homo sapiens
tgccttgagaccctccacc

SEQ ID NO: 82251 - DNA, 18 bp, Homo sapiens
tgccttggttccctcacc

SEQ ID NO: 82252 - DNA, 18 bp, Homo sapiens
tatcctaacgtttccacc

SEQ ID NO: 82253 - DNA, 21 bp, Homo sapiens
tgtcttgatggttcttccacc

SEQ ID NO: 82254 - DNA, 19 bp, Homo sapiens
tgtcctggcctgatctgcc

SEQ ID NO: 82255 - DNA, 20 bp, Homo sapiens
tgtctcgggtaggctccacc

SEQ ID NO: 82256 - DNA, 20 bp, Homo sapiens
tgtcctccagcctttccacc

SEQ ID NO: 82257 - DNA, 18 bp, Homo sapiens
tgtcttagtaagccccac

SEQ ID NO: 82258 - DNA, 19 bp, Homo sapiens
tgtcctggtgggttccacc

SEQ ID NO: 82259 - DNA, 18 bp, Homo sapiens
tgtctcgatctcttcacc

SEQ ID NO: 82260 - DNA, 107 bp, Sulfolobus virus SIRV-1
taaagctttctctatctttttatctctttaatttttcaaccttctgaattaatatcataaacttgagaaaaattattgataaaattagataatttatggaaaattta

SEQ ID NO: 82261 - DNA, 24 bp, Sulfolobus virus SIRV-1
tctatctttttatctctttaattt

SEQ ID NO: 82262 - DNA, 19 bp, Homo sapiens
tctgcttcactctttaatt

SEQ ID NO: 82263 - DNA, 21 bp, Homo sapiens
tccattttttccctttaattt

SEQ ID NO: 82264 - DNA, 19 bp, Homo sapiens
tcctaatatctctttgatt

SEQ ID NO: 82265 - DNA, 26 bp, Homo sapiens
tcagtctgtacttgtctctttaattt

SEQ ID NO: 82266 - DNA, 20 bp, Homo sapiens
tctctttatctctttaattt

SEQ ID NO: 82267 - DNA, 19 bp, Homo sapiens
tcttctttttatcttcttt

SEQ ID NO: 82268 - DNA, 15 bp, Homo sapiens
tatcttccctcttta

SEQ ID NO: 82269 - DNA, 16 bp, Homo sapiens
tctctctctttaattt

SEQ ID NO: 82270 - DNA, 21 bp, Homo sapiens
tctttctttttatctttctct

SEQ ID NO: 82271 - DNA, 97 bp, Sonchus yellow net virus
gaaagcacacgatacacatgtatccagtatgctatatgattaacataattataaaattatgatgataaatggggtatagggattgttctgagctttt

SEQ ID NO: 82272 - DNA, 24 bp, Sonchus yellow net virus
aagcacacgatacacatgtatcca

SEQ ID NO: 82273 - DNA, 20 bp, Homo sapiens
agcacacggttcaggctcca

SEQ ID NO: 82274 - DNA, 21 bp, Homo sapiens
aagcacacaggtataagtcca

SEQ ID NO: 82275 - DNA, 22 bp, Homo sapiens
aagcatcattcatatgtatcca

SEQ ID NO: 82276 - DNA, 17 bp, Homo sapiens
aaacacacacactatgt

SEQ ID NO: 82277 - DNA, 19 bp, Homo sapiens
aagcacacgtgatacatat

SEQ ID NO: 82278 - DNA, 18 bp, Homo sapiens
acattacacacgtgtatc

SEQ ID NO: 82279 - DNA, 16 bp, Homo sapiens
gcatcgatacatatcc

SEQ ID NO: 82280 - DNA, 23 bp, Homo sapiens
aagtacacatcagcctgtatcca

SEQ ID NO: 82281 - DNA, 17 bp, Homo sapiens
agcacacggtatacagt

SEQ ID NO: 82282 - DNA, 23 bp, Homo sapiens
agcacacgaatgtgtgtgtgcca

SEQ ID NO: 82283 - DNA, 20 bp, Homo sapiens
agtacagatacacaaaacca

SEQ ID NO: 82284 - DNA, 21 bp, Homo sapiens
aagcacacggaatgcgcaccc

SEQ ID NO: 82285 - DNA, 18 bp, Homo sapiens
aagtacacgatatacatg

SEQ ID NO: 82286 - DNA, 22 bp, Homo sapiens
aagcatttgatatgtgcaccca

SEQ ID NO: 82287 - DNA, 24 bp, Homo sapiens
aagcacacagtatatcagattcca

SEQ ID NO: 82288 - DNA, 16 bp, Homo sapiens
aagcacacatacatgt

SEQ ID NO: 82289 - DNA, 19 bp, Homo sapiens
gcacttacacatgtattca

SEQ ID NO: 82290 - DNA, 18 bp, Homo sapiens
agcacacagtatgctccc

SEQ ID NO: 82291 - DNA, 20 bp, Homo sapiens
aagcacactgatgcacaagt

SEQ ID NO: 82292 - DNA, 18 bp, Homo sapiens
agcacgcgacatgcaccc

SEQ ID NO: 82293 - DNA, 19 bp, Homo sapiens
aagcacagatacacaatcc

SEQ ID NO: 82294 - DNA, 16 bp, Homo sapiens
agcacatgatgcatcc

SEQ ID NO: 82295 - DNA, 15 bp, Homo sapiens
agcacacgaatgcac

SEQ ID NO: 82296 - DNA, 18 bp, Homo sapiens
aagcacatcatacacatg

SEQ ID NO: 82297 - DNA, 17 bp, Homo sapiens
aagcaataccatgtatc

SEQ ID NO: 82298 - DNA, 16 bp, Homo sapiens
aacatacgatacaatc

SEQ ID NO: 82299 - DNA, 16 bp, Homo sapiens
aagcacacgatcaccc

SEQ ID NO: 82300 - DNA, 20 bp, Homo sapiens
acaacgatttgtacatgtat

SEQ ID NO: 82301 - DNA, 20 bp, Homo sapiens
aagcacaccatacactgtac

SEQ ID NO: 82302 - DNA, 18 bp, Homo sapiens
aagcacactgttgtatcc

SEQ ID NO: 82303 - DNA, 18 bp, Homo sapiens
aaacattgacacatgtat

SEQ ID NO: 82304 - DNA, 20 bp, Homo sapiens
aagcacatgtacacacatgt

SEQ ID NO: 82305 - DNA, 16 bp, Homo sapiens
gcaacgatacatgcat

SEQ ID NO: 82306 - DNA, 20 bp, Homo sapiens
acatgctacacacacatcca

SEQ ID NO: 82307 - DNA, 22 bp, Homo sapiens
aagcacacagtgtgcgccccca

SEQ ID NO: 82308 - DNA, 18 bp, Homo sapiens
aagcacacgaacgtctcc

SEQ ID NO: 82309 - DNA, 17 bp, Homo sapiens
agccacgatacatacgt

SEQ ID NO: 82310 - DNA, 19 bp, Homo sapiens
gcacacgaaaccacatcca

SEQ ID NO: 82311 - DNA, 21 bp, Homo sapiens
agcagaccacgcatgtatcca

SEQ ID NO: 82312 - DNA, 17 bp, Homo sapiens
agcacatcacatgtatc

SEQ ID NO: 82313 - DNA, 16 bp, Homo sapiens
agcacacatacacagc

SEQ ID NO: 82314 - DNA, 18 bp, Homo sapiens
aagcacacgaatgcatgt

SEQ ID NO: 82315 - DNA, 21 bp, Homo sapiens
agcgcacggtgcacacatcca

SEQ ID NO: 82316 - DNA, 21 bp, Homo sapiens
aagcacacgagtatacttcca

SEQ ID NO: 82317 - DNA, 64 bp, Porcine reproductive and respiratory syndrome virus
gaggcatctcagtgtttgaattggaagaatgtgtggtgaatggcactgattgacattgtgcctc

SEQ ID NO: 82318 - DNA, 21 bp, Porcine reproductive and respiratory syndrome virus
cactgattgacattgtgcctc

SEQ ID NO: 82319 - DNA, 19 bp, Homo sapiens
cactgattacagcaggcct

SEQ ID NO: 82320 - DNA, 20 bp, Homo sapiens
actggtgacacctgtgcctc

SEQ ID NO: 82321 - DNA, 18 bp, Homo sapiens
cactgtttgacattcagc

SEQ ID NO: 82322 - DNA, 20 bp, Homo sapiens
actgacttcctattgtgcct

SEQ ID NO: 82323 - DNA, 20 bp, Homo sapiens
cagtgacaaatattgtgcct

SEQ ID NO: 82324 - DNA, 16 bp, Homo sapiens
tgattgacagctcccc

SEQ ID NO: 82325 - DNA, 18 bp, Homo sapiens
cattgattgactgagccc

SEQ ID NO: 82326 - DNA, 18 bp, Homo sapiens
ctgctgggtttgtgcctc

SEQ ID NO: 82327 - DNA, 18 bp, Homo sapiens
cactgactgacaggcctc

SEQ ID NO: 82328 - DNA, 21 bp, Homo sapiens
cagtgccatgcattgtgcttc

SEQ ID NO: 82329 - DNA, 17 bp, Homo sapiens
actgattggccccgccc

SEQ ID NO: 82330 - DNA, 16 bp, Homo sapiens
cactgattgtgtggct

SEQ ID NO: 82331 - DNA, 19 bp, Homo sapiens
tgatggtgaagtgtgcctc

SEQ ID NO: 82332 - DNA, 18 bp, Homo sapiens
ctgatgacatcaaacact

SEQ ID NO: 82333 - DNA, 18 bp, Homo sapiens
ctggttgacctgcgcctc

SEQ ID NO: 82334 - DNA, 18 bp, Homo sapiens
cactggtcccctgtgcct

SEQ ID NO: 82335 - DNA, 16 bp, Homo sapiens
cactgatcacgtgcct

SEQ ID NO: 82336 - DNA, 16 bp, Homo sapiens
tgattgactgcgcttc

SEQ ID NO: 82337 - DNA, 19 bp, Homo sapiens
cacggatggatttgtgcct

SEQ ID NO: 82338 - DNA, 18 bp, Homo sapiens
tgctgggcattgtgcttc

SEQ ID NO: 82339 - DNA, 20 bp, Homo sapiens
actgactcggtatgtgcctc

SEQ ID NO: 82340 - DNA, 17 bp, Homo sapiens
actgatgactgtgcctc

SEQ ID NO: 82341 - DNA, 18 bp, Homo sapiens
cactgttgacattcttgc

SEQ ID NO: 82342 - DNA, 20 bp, Homo sapiens
cattgagtgagaccatgcct

SEQ ID NO: 82343 - DNA, 19 bp, Homo sapiens
tgattcccatttgtgcctc

SEQ ID NO: 82344 - DNA, 20 bp, Homo sapiens
taattgacacatgactgtgc

SEQ ID NO: 82345 - DNA, 18 bp, Homo sapiens
cactgattcacagctact

SEQ ID NO: 82346 - DNA, 19 bp, Homo sapiens
tgatggtgagatgtgcctc

SEQ ID NO: 82347 - DNA, 16 bp, Homo sapiens
tgatgcattgtgcttc

SEQ ID NO: 82348 - DNA, 21 bp, Homo sapiens
cactaattgggccgctgcctc

SEQ ID NO: 82349 - DNA, 19 bp, Homo sapiens
ctgaaaactgattgtgcct

SEQ ID NO: 82350 - DNA, 22 bp, Homo sapiens
cactgattagcatgctggtcct

SEQ ID NO: 82351 - DNA, 20 bp, Homo sapiens
aattgatgcattttgtgcct

SEQ ID NO: 82352 - DNA, 17 bp, Homo sapiens
actgctgtgctgtgcct

SEQ ID NO: 82353 - DNA, 19 bp, Homo sapiens
caccaaaacattgtgcttc

SEQ ID NO: 82354 - DNA, 22 bp, Homo sapiens
cactgattgcaaaataggtctc

SEQ ID NO: 82355 - DNA, 18 bp, Homo sapiens
ctgctggcatttgtgcct

SEQ ID NO: 82356 - DNA, 19 bp, Homo sapiens
cactgtattggcatcagtg

SEQ ID NO: 82357 - DNA, 20 bp, Homo sapiens
cactgattgcaaacgtatct

SEQ ID NO: 82358 - DNA, 17 bp, Homo sapiens
cactgtatcctgtgcct

SEQ ID NO: 82359 - DNA, 20 bp, Homo sapiens
cactaattgatgtccagcct

SEQ ID NO: 82360 - DNA, 18 bp, Homo sapiens
cactatcttgctgtgcct

SEQ ID NO: 82361 - DNA, 21 bp, Homo sapiens
ctgattgatgtctgatgtctc

SEQ ID NO: 82362 - DNA, 18 bp, Homo sapiens
actgagtgacattgcctc

SEQ ID NO: 82363 - DNA, 18 bp, Homo sapiens
actgattaaatgatgcct

SEQ ID NO: 82364 - DNA, 22 bp, Homo sapiens
actgatctacagcattgtgcct

SEQ ID NO: 82365 - DNA, 19 bp, Homo sapiens
cactcagaacttgtgcctc

SEQ ID NO: 82366 - DNA, 17 bp, Homo sapiens
ctgattcaccacacctc

SEQ ID NO: 82367 - DNA, 15 bp, Homo sapiens
cactgattggtgcct

SEQ ID NO: 82368 - DNA, 19 bp, Homo sapiens
actgaaacagtttgtgcct

SEQ ID NO: 82369 - DNA, 16 bp, Homo sapiens
cccctgcattgtgcct

SEQ ID NO: 82370 - DNA, 18 bp, Homo sapiens
aattgatgtctgtgcctc

SEQ ID NO: 82371 - DNA, 23 bp, Homo sapiens
cactgatcggtgttcgcgtgcct

SEQ ID NO: 82372 - DNA, 20 bp, Homo sapiens
cattgggtaacctgtgcctc

SEQ ID NO: 82373 - DNA, 17 bp, Homo sapiens
cactaggcattgtgcct

SEQ ID NO: 82374 - DNA, 20 bp, Homo sapiens
cactgatttcaaagtgtctc

SEQ ID NO: 82375 - DNA, 20 bp, Homo sapiens
cactgattgataaaatatct

SEQ ID NO: 82376 - DNA, 21 bp, Homo sapiens
cactgattaagtattgtgcct

SEQ ID NO: 82377 - DNA, 18 bp, Homo sapiens
tgttcgtcagtgtgcctc

SEQ ID NO: 82378 - DNA, 18 bp, Homo sapiens
cacagtacattgtgcctc

SEQ ID NO: 82379 - DNA, 20 bp, Homo sapiens
cagtgattgacaggcccctc

SEQ ID NO: 82380 - DNA, 19 bp, Homo sapiens
actaattggcatctggctc

SEQ ID NO: 82381 - DNA, 19 bp, Homo sapiens
taactaagcattgtgcttc

SEQ ID NO: 82382 - DNA, 18 bp, Homo sapiens
cactgattgtccactagc

SEQ ID NO: 82383 - DNA, 17 bp, Homo sapiens
cttattgattgcccctc

SEQ ID NO: 82384 - DNA, 17 bp, Homo sapiens
actgaatgtttgtgcct

SEQ ID NO: 82385 - DNA, 16 bp, Homo sapiens
actgactggctgaccc

SEQ ID NO: 82386 - DNA, 18 bp, Homo sapiens
ctgatccaactgtgcctc

SEQ ID NO: 82387 - DNA, 130 bp, Porcine reproductive and respiratory syndrome virus
attcttgaggcatctcagtgtttgaattggaagaatgtgtggtgaatggcactgattgacattgtgcctctaagtcacctattcaattagggcgaccgtgtgggggtgagatttaattggcgagaaccat

SEQ ID NO: 82388 - DNA, 24 bp, Porcine reproductive and respiratory syndrome virus
tggaagaatgtgtggtgaatggca

SEQ ID NO: 82389 - DNA, 20 bp, Homo sapiens
tggaagaaagtgtttcatgg

SEQ ID NO: 82390 - DNA, 19 bp, Homo sapiens
tgggagatggggtgaatgg

SEQ ID NO: 82391 - DNA, 21 bp, Homo sapiens
tggagaatgtgtttgctgtgg

SEQ ID NO: 82392 - DNA, 20 bp, Homo sapiens
tgggggaatgtgtgagttgc

SEQ ID NO: 82393 - DNA, 24 bp, Homo sapiens
tgggagcatgtgaataaaatggca

SEQ ID NO: 82394 - DNA, 21 bp, Homo sapiens
gaagagtggggatgagtggca

SEQ ID NO: 82395 - DNA, 20 bp, Homo sapiens
tggaagaagtgtgtggaggg

SEQ ID NO: 82396 - DNA, 17 bp, Homo sapiens
tggagcctggtgaatgg

SEQ ID NO: 82397 - DNA, 18 bp, Homo sapiens
ggaagagtgtgtggctgc

SEQ ID NO: 82398 - DNA, 22 bp, Homo sapiens
tgggggatgtgcggggatggca

SEQ ID NO: 82399 - DNA, 24 bp, Homo sapiens
tggaagaatgtcagaagaatggca

SEQ ID NO: 82400 - DNA, 22 bp, Homo sapiens
gaggaatgtgtgggtccgtggc

SEQ ID NO: 82401 - DNA, 18 bp, Homo sapiens
tggtagaatgtggtggca

SEQ ID NO: 82402 - DNA, 17 bp, Homo sapiens
tgggagaatgtgtgtga

SEQ ID NO: 82403 - DNA, 19 bp, Homo sapiens
tgagggaattaatgaatgg

SEQ ID NO: 82404 - DNA, 15 bp, Homo sapiens
gaaggcggtgaatgg

SEQ ID NO: 82405 - DNA, 18 bp, Homo sapiens
tggtggaatgtattggtg

SEQ ID NO: 82406 - DNA, 21 bp, Homo sapiens
tgtaagaatgtagtgagatgg

SEQ ID NO: 82407 - DNA, 18 bp, Homo sapiens
ggacagtgtcgtgaatgg

SEQ ID NO: 82408 - DNA, 20 bp, Homo sapiens
tggaggactgtgtggtctgg

SEQ ID NO: 82409 - DNA, 18 bp, Homo sapiens
tgggggatgtgatgatgg

SEQ ID NO: 82410 - DNA, 25 bp, Homo sapiens
tggaagaggtgacgaaagggtggca

SEQ ID NO: 82411 - DNA, 21 bp, Homo sapiens
tgggaaaatgtgtccctggca

SEQ ID NO: 82412 - DNA, 18 bp, Homo sapiens
tggaaaatgtgtatggtg

SEQ ID NO: 82413 - DNA, 21 bp, Homo sapiens
tggtgggaatgtaaaatggca

SEQ ID NO: 82414 - DNA, 20 bp, Homo sapiens
tggacggatgtttgaatggc

SEQ ID NO: 82415 - DNA, 20 bp, Homo sapiens
tggagatcctgggtgaatgg

SEQ ID NO: 82416 - DNA, 24 bp, Homo sapiens
tgggggagggtggcaaacatggca

SEQ ID NO: 82417 - DNA, 19 bp, Homo sapiens
tgtgagaatgtgtggctga

SEQ ID NO: 82418 - DNA, 20 bp, Homo sapiens
tggagaggtctgtgagtggc

SEQ ID NO: 82419 - DNA, 23 bp, Homo sapiens
ggaagaatgttcggttgaatggc

SEQ ID NO: 82420 - DNA, 72 bp, Paramecium bursaria Chlorella virus 1
cgacgttccttcaatatttctttaacgccatcgtgaaactcttttcctgatcgtgatagatttatcacgtcg

SEQ ID NO: 82421 - DNA, 23 bp, Paramecium bursaria Chlorella virus 1
atcgtgatagatttatcacgtcg

SEQ ID NO: 82422 - DNA, 19 bp, Homo sapiens
gtgacagattttaaaatcg

SEQ ID NO: 82423 - DNA, 18 bp, Homo sapiens
atcggatagatttgtcca

SEQ ID NO: 82424 - DNA, 65 bp, Lymphocystis disease virus 1
tatgttataaaacagtgtagcgttgaattttaaaaaaatccaacattatactgttttataatata

SEQ ID NO: 82425 - DNA, 24 bp, Lymphocystis disease virus 1
tataaaacagtgtagcgttgaatt

SEQ ID NO: 82426 - DNA, 17 bp, Homo sapiens
taaaacagatgcgttga

SEQ ID NO: 82427 - DNA, 18 bp, Homo sapiens
taaaacagagtaggggtt

SEQ ID NO: 82428 - DNA, 20 bp, Homo sapiens
aaaacagtgtaacctgaatt

SEQ ID NO: 82429 - DNA, 20 bp, Homo sapiens
tatagcacagtgtagtcatt

SEQ ID NO: 82430 - DNA, 20 bp, Homo sapiens
tataaaacagtgatttagtt

SEQ ID NO: 82431 - DNA, 22 bp, Homo sapiens
taaaacagtgcggcttccaatt

SEQ ID NO: 82432 - DNA, 16 bp, Homo sapiens
aaacagtgtaataaat

SEQ ID NO: 82433 - DNA, 17 bp, Homo sapiens
taagacagtgtaggaat

SEQ ID NO: 82434 - DNA, 72 bp, Chimpanzee cytomegalovirus
ccgtggcgtaaatataggacatagatcggtacagatacaccgtcacctgatcaccccctatactatctatgg

SEQ ID NO: 82435 - DNA, 24 bp, Chimpanzee cytomegalovirus
taggacatagatcggtacagatac

SEQ ID NO: 82436 - DNA, 20 bp, Homo sapiens
ggatgacccaggtacagata

SEQ ID NO: 82437 - DNA, 20 bp, Homo sapiens
tagggtaaaatatacagata

SEQ ID NO: 82438 - DNA, 19 bp, Homo sapiens
taggacatactacgtacag

SEQ ID NO: 82439 - DNA, 18 bp, Homo sapiens
ggacaaaggtacagatac

SEQ ID NO: 82440 - DNA, 20 bp, Homo sapiens
ggatataacacttacagata

SEQ ID NO: 82441 - DNA, 17 bp, Homo sapiens
ggacatggctacagata

SEQ ID NO: 82442 - DNA, 17 bp, Homo sapiens
agacatcagtacagata

SEQ ID NO: 82443 - DNA, 18 bp, Homo sapiens
taggagtagttacagata

SEQ ID NO: 82444 - DNA, 19 bp, Homo sapiens
tagggcacagagcacagat

SEQ ID NO: 82445 - DNA, 19 bp, Homo sapiens
gacgtaagcatacagatac

SEQ ID NO: 82446 - DNA, 19 bp, Homo sapiens
caggacgtgggacacagat

SEQ ID NO: 82447 - DNA, 20 bp, Homo sapiens
tagggcacacagatatgggt

SEQ ID NO: 82448 - DNA, 22 bp, Homo sapiens
taggatctaaagaatacagata

SEQ ID NO: 82449 - DNA, 21 bp, Homo sapiens
ggagtaaagttgtacagatac

SEQ ID NO: 82450 - DNA, 19 bp, Homo sapiens
ggactggcaggacagatac

SEQ ID NO: 82451 - DNA, 19 bp, Homo sapiens
tagggctaggccacagata

SEQ ID NO: 82452 - DNA, 65 bp, Human herpesvirus 1
acactttcccgcgtgtcgcgtgtggttcatgtgtgtgcctggcgcccccaccctcgggttcgtgt

SEQ ID NO: 82453 - DNA, 24 bp, Human herpesvirus 1
tgcctggcgcccccaccctcgggt

SEQ ID NO: 82454 - DNA, 19 bp, Homo sapiens
tgcccggcgcccccactcc

SEQ ID NO: 82455 - DNA, 19 bp, Homo sapiens
gcttggggcgccctcgggt

SEQ ID NO: 82456 - DNA, 23 bp, Homo sapiens
tgcctggtgccacaagcttgggt

SEQ ID NO: 82457 - DNA, 18 bp, Homo sapiens
gccggctccatcctcggg

SEQ ID NO: 82458 - DNA, 19 bp, Homo sapiens
cctggcgcttccaccctgg

SEQ ID NO: 82459 - DNA, 21 bp, Homo sapiens
tgcttgggcaggacctcgggt

SEQ ID NO: 82460 - DNA, 21 bp, Homo sapiens
tgcctcgggccacctttgggt

SEQ ID NO: 82461 - DNA, 25 bp, Homo sapiens
tgcctggcctccctgtgtacccgag

SEQ ID NO: 82462 - DNA, 22 bp, Homo sapiens
tgcatggcggggctcctcgggt

SEQ ID NO: 82463 - DNA, 18 bp, Homo sapiens
tgcctggcgccctccccg

SEQ ID NO: 82464 - DNA, 21 bp, Homo sapiens
tgcctggcctcccctgggggt

SEQ ID NO: 82465 - DNA, 23 bp, Homo sapiens
tgctgggcgcccctgggcagggt

SEQ ID NO: 82466 - DNA, 23 bp, Homo sapiens
tacctgaagcttcatcctcgggt

SEQ ID NO: 82467 - DNA, 23 bp, Homo sapiens
tgcctgggccccgggcattgggt

SEQ ID NO: 82468 - DNA, 20 bp, Homo sapiens
gcctggcgctcctgtcagat

SEQ ID NO: 82469 - DNA, 23 bp, Homo sapiens
tgcctggcacctcatggatgggt

SEQ ID NO: 82470 - DNA, 21 bp, Homo sapiens
tgtctgccactgtcctcgggt

SEQ ID NO: 82471 - DNA, 18 bp, Homo sapiens
cctggcgctccccatggg

SEQ ID NO: 82472 - DNA, 28 bp, Homo sapiens
tgcctggcgccgcccgtgtacccgaggg

SEQ ID NO: 82473 - DNA, 25 bp, Homo sapiens
tgcttggcgccctggcgtacccgag

SEQ ID NO: 82474 - DNA, 18 bp, Homo sapiens
tgtctggctgccctcgag

SEQ ID NO: 82475 - DNA, 22 bp, Homo sapiens
tgccggcgcccttgccacgggt

SEQ ID NO: 82476 - DNA, 19 bp, Homo sapiens
gcctggcgcctccaccccc

SEQ ID NO: 82477 - DNA, 21 bp, Homo sapiens
tgcctggccctctgctcccac

SEQ ID NO: 82478 - DNA, 20 bp, Homo sapiens
gcctggcgctcccgcacggt

SEQ ID NO: 82479 - DNA, 21 bp, Homo sapiens
tgctaggcgcccctgcagggt

SEQ ID NO: 82480 - DNA, 18 bp, Homo sapiens
tacctggcgctctcgcgg

SEQ ID NO: 82481 - DNA, 18 bp, Homo sapiens
cctggcgctcctgcgagg

SEQ ID NO: 82482 - DNA, 19 bp, Homo sapiens
tgcctggctgtccctgggg

SEQ ID NO: 82483 - DNA, 19 bp, Homo sapiens
tgcctggccttccgctcag

SEQ ID NO: 82484 - DNA, 131 bp, Human adenovirus C
tgcgtgtgtggttaacgcctttgtttgctgaatgagttgatgtaagtttaataaagggtgagataatgtttaacttgcatggcgtgttaaatggggcggggcttaaagggtatataatgcgccgtgggcta

SEQ ID NO: 82485 - DNA, 24 bp, Human adenovirus C
ttgcatggcgtgttaaatggggcg

SEQ ID NO: 82486 - DNA, 19 bp, Homo sapiens
ttgcatggcgggggtgggg

SEQ ID NO: 82487 - DNA, 18 bp, Homo sapiens
tcacattgttaaatgggg

SEQ ID NO: 82488 - DNA, 21 bp, Homo sapiens
ttacatggtggcagaatgggg

SEQ ID NO: 82489 - DNA, 85 bp, Human adenovirus B
gtgctccgcacctgtgtttatctaatgtgacgtcactgtttttgtgagagtgtcatgtaataaaattatgtcagcagctgagtgt

SEQ ID NO: 82490 - DNA, 19 bp, Human adenovirus B
tatgtcagcagctgagtgt

SEQ ID NO: 82491 - DNA, 18 bp, Homo sapiens
catgtcagtgcacagtgt

SEQ ID NO: 82492 - DNA, 22 bp, Homo sapiens
tatgtcagaagcagggctgtgt

SEQ ID NO: 82493 - DNA, 18 bp, Homo sapiens
tgcagagcagctgagtgt

SEQ ID NO: 82494 - DNA, 18 bp, Homo sapiens
tatgccagctggaagtgt

SEQ ID NO: 82495 - DNA, 18 bp, Homo sapiens
tgtaaaacagctgagtgt

SEQ ID NO: 82496 - DNA, 18 bp, Homo sapiens
tatgtcagaagaaagtgt

SEQ ID NO: 82497 - DNA, 16 bp, Homo sapiens
catgaccgctgagtgt

SEQ ID NO: 82498 - DNA, 18 bp, Homo sapiens
atctgaacagctgagtgt

SEQ ID NO: 82499 - DNA, 18 bp, Homo sapiens
tatgtagcctctgagtgt

SEQ ID NO: 82500 - DNA, 18 bp, Homo sapiens
tatatcagtgcaaagtgt

SEQ ID NO: 82501 - DNA, 19 bp, Homo sapiens
tatgtcaaaaaaggagtgt

SEQ ID NO: 82502 - DNA, 15 bp, Homo sapiens
catgtagctgagtgt

SEQ ID NO: 82503 - DNA, 18 bp, Homo sapiens
tatgccagtagacaaggt

SEQ ID NO: 82504 - DNA, 19 bp, Homo sapiens
catgtcagcagaatctggt

SEQ ID NO: 82505 - DNA, 18 bp, Homo sapiens
tatctcaagcctgagtgt

SEQ ID NO: 82506 - DNA, 18 bp, Homo sapiens
tatgtcaacgggcaatgt

SEQ ID NO: 82507 - DNA, 20 bp, Homo sapiens
tatatcagcagaaatagtgt

SEQ ID NO: 82508 - DNA, 18 bp, Homo sapiens
tacgtgtaaactgagtgt

SEQ ID NO: 82509 - DNA, 17 bp, Homo sapiens
catgtcaaacagggtgt

SEQ ID NO: 82510 - DNA, 18 bp, Homo sapiens
tatgtcaatgactagtgt

SEQ ID NO: 82511 - DNA, 17 bp, Homo sapiens
atgtcagcagagaacgt

SEQ ID NO: 82512 - DNA, 18 bp, Homo sapiens
tatggcagcggccactgt

SEQ ID NO: 82513 - DNA, 18 bp, Homo sapiens
tatgctgaagctgagtgt

SEQ ID NO: 82514 - DNA, 15 bp, Homo sapiens
atgtcagcatgatgt

SEQ ID NO: 82515 - DNA, 18 bp, Homo sapiens
tatgtcatcagaaactgt

SEQ ID NO: 82516 - DNA, 18 bp, Homo sapiens
tatgtcagcatgccgagt

SEQ ID NO: 82517 - DNA, 16 bp, Homo sapiens
catgtcagcagcgtgt

SEQ ID NO: 82518 - DNA, 20 bp, Homo sapiens
tatgtcagtggctggactgt

SEQ ID NO: 82519 - DNA, 19 bp, Homo sapiens
tatgccagcagttaaatgt

SEQ ID NO: 82520 - DNA, 18 bp, Homo sapiens
tatgccagaaatgagtgt

SEQ ID NO: 82521 - DNA, 107 bp, Gallid herpesvirus 2
aaacctggagaacttgtagggttgtatagtcgacaggatgtaggtggagacatgacgtctacaaagagacatcctataaggccattcctgcagaaacttataggttt

SEQ ID NO: 82522 - DNA, 24 bp, Gallid herpesvirus 2
taaggccattcctgcagaaactta

SEQ ID NO: 82523 - DNA, 15 bp, Homo sapiens
aggtcacagaaactt

SEQ ID NO: 82524 - DNA, 18 bp, Homo sapiens
caaggtcaacagaaactt

SEQ ID NO: 82525 - DNA, 16 bp, Homo sapiens
taaggccatctggact

SEQ ID NO: 82526 - DNA, 17 bp, Homo sapiens
taaggccacttgtaaga

SEQ ID NO: 82527 - DNA, 18 bp, Homo sapiens
taaggccagttcctggaa

SEQ ID NO: 82528 - DNA, 20 bp, Homo sapiens
taaggccacttttgggtaga

SEQ ID NO: 82529 - DNA, 19 bp, Homo sapiens
taagaccattcagccaaga

SEQ ID NO: 82530 - DNA, 19 bp, Homo sapiens
caaggccatccggagactt

SEQ ID NO: 82531 - DNA, 19 bp, Homo sapiens
ggccatgcagaaaggactt

SEQ ID NO: 82532 - DNA, 20 bp, Homo sapiens
aggtttattcctgcattctt

SEQ ID NO: 82533 - DNA, 17 bp, Homo sapiens
caaggcctctgcagaaa

SEQ ID NO: 82534 - DNA, 21 bp, Homo sapiens
ggctatttttgcagaaatcct

SEQ ID NO: 82535 - DNA, 22 bp, Homo sapiens
aggctatacaggacagaaactt

SEQ ID NO: 82536 - DNA, 118 bp, Human herpesvirus 8
taagataatctaaatattctctataacataattgtaatgtgttttatgtttatagctacaaatgttttatgcaaaatacattttatgaggtcggatacttattaaaagcattgtctta

SEQ ID NO: 82537 - DNA, 24 bp, Human herpesvirus 8
tctctataacataattgtaatgtg

SEQ ID NO: 82538 - DNA, 18 bp, Homo sapiens
tctctactgttgtaatgt

SEQ ID NO: 82539 - DNA, 22 bp, Homo sapiens
tctccataacatagtttcagtg

SEQ ID NO: 82540 - DNA, 18 bp, Homo sapiens
tctttaaacataattgta

SEQ ID NO: 82541 - DNA, 19 bp, Homo sapiens
tccataattctgtaatgtg

SEQ ID NO: 82542 - DNA, 21 bp, Homo sapiens
tcttttaacataattgcaatg

SEQ ID NO: 82543 - DNA, 92 bp, Chimpanzee cytomegalovirus
gagcggggaagacggcgagcgggccacggtggcggtcggagtcctcctcctgctgctcttgctgctactgcccctctcgcttcttcacgctc

SEQ ID NO: 82544 - DNA, 24 bp, Chimpanzee cytomegalovirus
tcttgctgctactgcccctctcgc

SEQ ID NO: 82545 - DNA, 22 bp, Homo sapiens
tcctgctgacattccctcttgc

SEQ ID NO: 82546 - DNA, 25 bp, Homo sapiens
tcctgccatacgttgcttctcttgc

SEQ ID NO: 82547 - DNA, 22 bp, Homo sapiens
tctggctgcctcctcctctcgc

SEQ ID NO: 82548 - DNA, 19 bp, Homo sapiens
tctcgctgttgctcgctcg

SEQ ID NO: 82549 - DNA, 19 bp, Homo sapiens
tcttgctgtcttccccgct

SEQ ID NO: 82550 - DNA, 20 bp, Homo sapiens
ttgtccgtgtgtccctctcg

SEQ ID NO: 82551 - DNA, 22 bp, Homo sapiens
tctggctgctggcccctcttgc

SEQ ID NO: 82552 - DNA, 19 bp, Homo sapiens
tcttttgctctccctctcg

SEQ ID NO: 82553 - DNA, 19 bp, Homo sapiens
tcctgctgctgctgctact

SEQ ID NO: 82554 - DNA, 21 bp, Homo sapiens
ccttgctgtctgctttcttgc

SEQ ID NO: 82555 - DNA, 25 bp, Homo sapiens
tccagccggctgctgcctctctcgc

SEQ ID NO: 82556 - DNA, 21 bp, Homo sapiens
tcttcctcttgctcctctcgc

SEQ ID NO: 82557 - DNA, 20 bp, Homo sapiens
tctgctgctgctgcttctgc

SEQ ID NO: 82558 - DNA, 17 bp, Homo sapiens
tcttgctgttacttccc

SEQ ID NO: 82559 - DNA, 19 bp, Homo sapiens
ttgctgctgctgcagccgc

SEQ ID NO: 82560 - DNA, 21 bp, Homo sapiens
tctgctgctgttgctgattct

SEQ ID NO: 82561 - DNA, 20 bp, Homo sapiens
ttgctcgctctccctctcgc

SEQ ID NO: 82562 - DNA, 19 bp, Homo sapiens
tgcttctggctcctctcgc

SEQ ID NO: 82563 - DNA, 20 bp, Homo sapiens
ctgctgctgtggagtcttgc

SEQ ID NO: 82564 - DNA, 21 bp, Homo sapiens
tcttgctgtgttgcccacact

SEQ ID NO: 82565 - DNA, 20 bp, Homo sapiens
tcttttgctcactgccctct

SEQ ID NO: 82566 - DNA, 22 bp, Homo sapiens
ctgctggacggcctcctctcgc

SEQ ID NO: 82567 - DNA, 92 bp, Amsacta moorei entomopoxvirus
atattaatattaaaatatgaacttagattttttatattaaatctataatattagaatatatatcttctatattttatattaaaaattaatat

SEQ ID NO: 82568 - DNA, 24 bp, Amsacta moorei entomopoxvirus
taaaatatgaacttagatttttta

SEQ ID NO: 82569 - DNA, 19 bp, Homo sapiens
aatatacttagatttttta

SEQ ID NO: 82570 - DNA, 21 bp, Homo sapiens
taaaatatgacatgatttttt

SEQ ID NO: 82571 - DNA, 25 bp, Homo sapiens
taaaatataaatttagacagattta

SEQ ID NO: 82572 - DNA, 17 bp, Homo sapiens
aatatgaactgattttt

SEQ ID NO: 82573 - DNA, 20 bp, Homo sapiens
aaatatgtctagatttttta

SEQ ID NO: 82574 - DNA, 92 bp, Tupaia herpesvirus
ggcgcacatgaggaatataatatagcaacagtcggctcgggccgacgacgggcgctcgctcggcgtcgactcggagccggccgattctcgtc

SEQ ID NO: 82575 - DNA, 24 bp, Tupaia herpesvirus
tgaggaatataatatagcaacagt

SEQ ID NO: 82576 - DNA, 22 bp, Homo sapiens
tgaggaatgtatcacaggcagt

SEQ ID NO: 82577 - DNA, 22 bp, Homo sapiens
tgagaaatatgagaacaatagt

SEQ ID NO: 82578 - DNA, 17 bp, Homo sapiens
tgaggaatgcacacagc

SEQ ID NO: 82579 - DNA, 19 bp, Homo sapiens
tgagaaatatgcttaacag

SEQ ID NO: 82580 - DNA, 21 bp, Homo sapiens
gaggaatatgagtaggacagt

SEQ ID NO: 82581 - DNA, 19 bp, Homo sapiens
tgaagaatgtaatgaacag

SEQ ID NO: 82582 - DNA, 25 bp, Homo sapiens
tgaggaatattaatacgatgacagt

SEQ ID NO: 82583 - DNA, 22 bp, Homo sapiens
tgaggaactgtaataataatag

SEQ ID NO: 82584 - DNA, 21 bp, Homo sapiens
tgaggaatatgcttcaacagt

SEQ ID NO: 82585 - DNA, 20 bp, Homo sapiens
taaggaatatgatgtaggca

SEQ ID NO: 82586 - DNA, 84 bp, Swinepox virus
ttataaaattattattgataataaatcattgaaaatatattattaatatattattaatatacacaataaataattaatttataa

SEQ ID NO: 82587 - DNA, 24 bp, Swinepox virus
tattattgataataaatcattgaa

SEQ ID NO: 82588 - DNA, 22 bp, Homo sapiens
attattggtgataaatcattaa

SEQ ID NO: 82589 - DNA, 20 bp, Homo sapiens
tactattgataataaaacca

SEQ ID NO: 82590 - DNA, 21 bp, Homo sapiens
taatgatcaatagatcattga

SEQ ID NO: 82591 - DNA, 66 bp, Simian-Human immunodeficiency virus
gtctaggggaaggacatggggcagggggatggagaccaggacctcctcctcctccccctccaggac

SEQ ID NO: 82592 - DNA, 24 bp, Simian-Human immunodeficiency virus
taggggaaggacatggggcagggg

SEQ ID NO: 82593 - DNA, 21 bp, Homo sapiens
gggtggggacgtgggcagggg

SEQ ID NO: 82594 - DNA, 20 bp, Homo sapiens
caggggaagggcatggctgg

SEQ ID NO: 82595 - DNA, 19 bp, Homo sapiens
ggggaaggcagggtggggg

SEQ ID NO: 82596 - DNA, 15 bp, Homo sapiens
ggggggagggcaggg

SEQ ID NO: 82597 - DNA, 21 bp, Homo sapiens
tagggtgacacgggggtgggg

SEQ ID NO: 82598 - DNA, 19 bp, Homo sapiens
taggagctgtggggcaggg

SEQ ID NO: 82599 - DNA, 20 bp, Homo sapiens
ggaggaggcaggggtggggg

SEQ ID NO: 82600 - DNA, 21 bp, Homo sapiens
aggggaagcagggggtggggg

SEQ ID NO: 82601 - DNA, 18 bp, Homo sapiens
caggggggcggggcaggg

SEQ ID NO: 82602 - DNA, 18 bp, Homo sapiens
gggggagggtggacaggg

SEQ ID NO: 82603 - DNA, 18 bp, Homo sapiens
taggggaagctggcaggg

SEQ ID NO: 82604 - DNA, 20 bp, Homo sapiens
ggggaggtgaggggcagggg

SEQ ID NO: 82605 - DNA, 21 bp, Homo sapiens
agggaagggatggctttgggg

SEQ ID NO: 82606 - DNA, 21 bp, Homo sapiens
gggggaggagaaaagcagggg

SEQ ID NO: 82607 - DNA, 21 bp, Homo sapiens
agggcaggcatggggcagggg

SEQ ID NO: 82608 - DNA, 25 bp, Homo sapiens
aggggaaggagtgggagggcagggg

SEQ ID NO: 82609 - DNA, 25 bp, Homo sapiens
gggggcaggaggatggggcgggggc

SEQ ID NO: 82610 - DNA, 18 bp, Homo sapiens
gggggagggatggggcag

SEQ ID NO: 82611 - DNA, 16 bp, Homo sapiens
cagggggaggggcagg

SEQ ID NO: 82612 - DNA, 20 bp, Homo sapiens
gggaggagggatagcagggg

SEQ ID NO: 82613 - DNA, 20 bp, Homo sapiens
ggaggaagggccggcggggg

SEQ ID NO: 82614 - DNA, 22 bp, Homo sapiens
aggggagggcagggggcggggg

SEQ ID NO: 82615 - DNA, 23 bp, Homo sapiens
ggggaagggtggtggatccgggg

SEQ ID NO: 82616 - DNA, 22 bp, Homo sapiens
ggggaagggactgaagcagggg

SEQ ID NO: 82617 - DNA, 21 bp, Homo sapiens
ggggtaggccttgggcagggg

SEQ ID NO: 82618 - DNA, 20 bp, Homo sapiens
ggggacacatggggcagggg

SEQ ID NO: 82619 - DNA, 20 bp, Homo sapiens
gggggtgggagcggcagggg

SEQ ID NO: 82620 - DNA, 17 bp, Homo sapiens
ggggaggggtggcaggg

SEQ ID NO: 82621 - DNA, 20 bp, Homo sapiens
ggggcaagggcgaagagggg

SEQ ID NO: 82622 - DNA, 18 bp, Homo sapiens
gggggcagcagggcaggg

SEQ ID NO: 82623 - DNA, 22 bp, Homo sapiens
ggggagggcatgggggcagggg

SEQ ID NO: 82624 - DNA, 17 bp, Homo sapiens
ggggtggggggcaagag

SEQ ID NO: 82625 - DNA, 19 bp, Homo sapiens
gggaaaggatatggtgtgg

SEQ ID NO: 82626 - DNA, 17 bp, Homo sapiens
aggggaaggaggcgggg

SEQ ID NO: 82627 - DNA, 24 bp, Homo sapiens
ggaggaagggaagcagggcagggg

SEQ ID NO: 82628 - DNA, 22 bp, Homo sapiens
ggggaagggggtgggacagggg

SEQ ID NO: 82629 - DNA, 19 bp, Homo sapiens
gggagaggtggggcagggg

SEQ ID NO: 82630 - DNA, 18 bp, Homo sapiens
gggggggcaggggcgggg

SEQ ID NO: 82631 - DNA, 20 bp, Homo sapiens
aggaaggcatggggcggggg

SEQ ID NO: 82632 - DNA, 18 bp, Homo sapiens
ggggagccggggcagggg

SEQ ID NO: 82633 - DNA, 21 bp, Homo sapiens
aggggaggggagaggcagggg

SEQ ID NO: 82634 - DNA, 22 bp, Homo sapiens
ggggaagggcctggggcggggg

SEQ ID NO: 82635 - DNA, 19 bp, Homo sapiens
agggagaggagggcagggg

SEQ ID NO: 82636 - DNA, 18 bp, Homo sapiens
aggggaagggcactgggg

SEQ ID NO: 82637 - DNA, 22 bp, Homo sapiens
taggggaagggagactttgggg

SEQ ID NO: 82638 - DNA, 23 bp, Homo sapiens
gggggaggggatgacagcaaggg

SEQ ID NO: 82639 - DNA, 22 bp, Homo sapiens
aggggaaggaggggggcggggg

SEQ ID NO: 82640 - DNA, 22 bp, Homo sapiens
gggggcaggggctgggcggggg

SEQ ID NO: 82641 - DNA, 20 bp, Homo sapiens
aggggaggggagggcagggg

SEQ ID NO: 82642 - DNA, 21 bp, Homo sapiens
ggaggagggggtcagcagggg

SEQ ID NO: 82643 - DNA, 22 bp, Homo sapiens
aggggagtccctggggtggggg

SEQ ID NO: 82644 - DNA, 18 bp, Homo sapiens
ggggaaggagatgggagg

SEQ ID NO: 82645 - DNA, 17 bp, Homo sapiens
aggggaaggaggtaggg

SEQ ID NO: 82646 - DNA, 15 bp, Homo sapiens
ggggggggggcaagg

SEQ ID NO: 82647 - DNA, 20 bp, Homo sapiens
ggggaatggtgcagcagggg

SEQ ID NO: 82648 - DNA, 21 bp, Homo sapiens
ggaacaagtgtggggtggggg

SEQ ID NO: 82649 - DNA, 20 bp, Homo sapiens
ggggagggacaggagagggg

SEQ ID NO: 82650 - DNA, 25 bp, Homo sapiens
ggggtggggacacggaaggcagggg

SEQ ID NO: 82651 - DNA, 20 bp, Homo sapiens
gggaggggcaggggcagggg

SEQ ID NO: 82652 - DNA, 21 bp, Homo sapiens
gggggtgcggtggggcagggg

SEQ ID NO: 82653 - DNA, 20 bp, Homo sapiens
aggggctggtggggtggggg

SEQ ID NO: 82654 - DNA, 15 bp, Homo sapiens
ggggaaggggcaggg

SEQ ID NO: 82655 - DNA, 23 bp, Homo sapiens
ggggaagggggcaagggcagggg

SEQ ID NO: 82656 - DNA, 15 bp, Homo sapiens
gggaggaggagcagg

SEQ ID NO: 82657 - DNA, 20 bp, Homo sapiens
ggggagaggcaggactgggg

SEQ ID NO: 82658 - DNA, 27 bp, Homo sapiens
tagggcaggggcactgagaggcagggg

SEQ ID NO: 82659 - DNA, 22 bp, Homo sapiens
ggaggagggacagggcgtgggg

SEQ ID NO: 82660 - DNA, 23 bp, Homo sapiens
taggggagagggaaaggcagggg

SEQ ID NO: 82661 - DNA, 22 bp, Homo sapiens
aggggaggaccgtgggtggggg

SEQ ID NO: 82662 - DNA, 19 bp, Homo sapiens
ggggagcccagggcagggg

SEQ ID NO: 82663 - DNA, 15 bp, Homo sapiens
tagaggaggggcaag

SEQ ID NO: 82664 - DNA, 21 bp, Homo sapiens
ggggaaggggtttctgagggg

SEQ ID NO: 82665 - DNA, 20 bp, Homo sapiens
gggtgggggtggggcagggg

SEQ ID NO: 82666 - DNA, 24 bp, Homo sapiens
agggtgaagggtgtggggtggggg

SEQ ID NO: 82667 - DNA, 16 bp, Homo sapiens
ggggaagggggaaggg

SEQ ID NO: 82668 - DNA, 20 bp, Homo sapiens
gaggaaggggagggcagggg

SEQ ID NO: 82669 - DNA, 20 bp, Homo sapiens
gggggcaggagcagcagggg

SEQ ID NO: 82670 - DNA, 22 bp, Homo sapiens
aggggggcccgaggggcagggg

SEQ ID NO: 82671 - DNA, 15 bp, Homo sapiens
ggggagggggcaggg

SEQ ID NO: 82672 - DNA, 23 bp, Homo sapiens
ggggaaggagggcaccccagggg

SEQ ID NO: 82673 - DNA, 20 bp, Homo sapiens
agagggattgggggcagggg

SEQ ID NO: 82674 - DNA, 17 bp, Homo sapiens
gggtggaggggcagaag

SEQ ID NO: 82675 - DNA, 23 bp, Homo sapiens
ggggaagggtgggcacacagggg

SEQ ID NO: 82676 - DNA, 21 bp, Homo sapiens
ggggtggggcaaagtcagggg

SEQ ID NO: 82677 - DNA, 21 bp, Homo sapiens
taggggaaggaggaacagggg

SEQ ID NO: 82678 - DNA, 22 bp, Homo sapiens
ggggaaggtagcggggtggggg

SEQ ID NO: 82679 - DNA, 20 bp, Homo sapiens
agggaaggatatgttgtggg

SEQ ID NO: 82680 - DNA, 24 bp, Homo sapiens
gggaaagggtagttttggcagggg

SEQ ID NO: 82681 - DNA, 21 bp, Homo sapiens
caggggaagggagggcagggg

SEQ ID NO: 82682 - DNA, 20 bp, Homo sapiens
agggggaggggcgcccgggg

SEQ ID NO: 82683 - DNA, 18 bp, Homo sapiens
ggggcaaggaaggtgggg

SEQ ID NO: 82684 - DNA, 20 bp, Homo sapiens
ggggggagagggggcagggg

SEQ ID NO: 82685 - DNA, 21 bp, Homo sapiens
ggggaagggtggcatatgggg

SEQ ID NO: 82686 - DNA, 16 bp, Homo sapiens
taggggaaggggaagg

SEQ ID NO: 82687 - DNA, 16 bp, Homo sapiens
gggaaggacagcaggg

SEQ ID NO: 82688 - DNA, 20 bp, Homo sapiens
gggggggcggggggcagggg

SEQ ID NO: 82689 - DNA, 20 bp, Homo sapiens
gggcgggcaaggggtagggg

SEQ ID NO: 82690 - DNA, 16 bp, Homo sapiens
ggggaaggaggcaggg

SEQ ID NO: 82691 - DNA, 24 bp, Homo sapiens
tagggggcgaggcaggggtggggg

SEQ ID NO: 82692 - DNA, 23 bp, Homo sapiens
gggggtgagggtgggggcagggg

SEQ ID NO: 82693 - DNA, 19 bp, Homo sapiens
agggggggggagcaggtgg

SEQ ID NO: 82694 - DNA, 18 bp, Homo sapiens
taggggaagggggtggag

SEQ ID NO: 82695 - DNA, 21 bp, Homo sapiens
ggggatgggatggggcagggg

SEQ ID NO: 82696 - DNA, 20 bp, Homo sapiens
aggggagggggaggcagggg

SEQ ID NO: 82697 - DNA, 19 bp, Homo sapiens
ggggaaggacatggtcagg

SEQ ID NO: 82698 - DNA, 17 bp, Homo sapiens
ggggaaggagaggaggg

SEQ ID NO: 82699 - DNA, 19 bp, Homo sapiens
gggggaggacagacaaggg

SEQ ID NO: 82700 - DNA, 16 bp, Homo sapiens
ggggaagggggcgggg

SEQ ID NO: 82701 - DNA, 17 bp, Homo sapiens
ggggaaagggtagaggg

SEQ ID NO: 82702 - DNA, 21 bp, Homo sapiens
ggggaagggacttcttagggg

SEQ ID NO: 82703 - DNA, 17 bp, Homo sapiens
gggggacaggagcaggg

SEQ ID NO: 82704 - DNA, 25 bp, Homo sapiens
ggggagggaagcagaggggcggggg

SEQ ID NO: 82705 - DNA, 20 bp, Homo sapiens
aggggctggtggggcagggg

SEQ ID NO: 82706 - DNA, 23 bp, Homo sapiens
aggggagtgggatggggtggggg

SEQ ID NO: 82707 - DNA, 18 bp, Homo sapiens
aggggggtgggggtgggg

SEQ ID NO: 82708 - DNA, 18 bp, Homo sapiens
taggggaaagaggcaggg

SEQ ID NO: 82709 - DNA, 22 bp, Homo sapiens
gggtgggggagccgggcagggg

SEQ ID NO: 82710 - DNA, 21 bp, Homo sapiens
aggggaggttccgggtggggg

SEQ ID NO: 82711 - DNA, 23 bp, Homo sapiens
ggggagcgaggatggggcagggg

SEQ ID NO: 82712 - DNA, 22 bp, Homo sapiens
ggggaagggatgggaagagggg

SEQ ID NO: 82713 - DNA, 18 bp, Homo sapiens
ggtgggagcggggcaggg

SEQ ID NO: 82714 - DNA, 26 bp, Homo sapiens
taggggaagggcggacagcgcagggg

SEQ ID NO: 82715 - DNA, 21 bp, Homo sapiens
taggggcaaggggggcggggg

SEQ ID NO: 82716 - DNA, 26 bp, Homo sapiens
taggggaagggtgggggcattcaggg

SEQ ID NO: 82717 - DNA, 21 bp, Homo sapiens
ggggaaggagtcgggcagggg

SEQ ID NO: 82718 - DNA, 24 bp, Homo sapiens
ggggaaggaggatgtgggcggggg

SEQ ID NO: 82719 - DNA, 20 bp, Homo sapiens
ggggggggggtggggagagg

SEQ ID NO: 82720 - DNA, 23 bp, Homo sapiens
gggagaagggtatggagtggggg

SEQ ID NO: 82721 - DNA, 15 bp, Homo sapiens
ggggggaggacaggg

SEQ ID NO: 82722 - DNA, 20 bp, Homo sapiens
agggcgggcgcgggcagggg

SEQ ID NO: 82723 - DNA, 20 bp, Homo sapiens
aggggagacaggggtagggg

SEQ ID NO: 82724 - DNA, 20 bp, Homo sapiens
ggggcgggttggggcggggg

SEQ ID NO: 82725 - DNA, 24 bp, Homo sapiens
gaggatgtgggtgtggggtggggg

SEQ ID NO: 82726 - DNA, 18 bp, Homo sapiens
gggaggggggagcagggg

SEQ ID NO: 82727 - DNA, 18 bp, Homo sapiens
aggggaggcagggcaggg

SEQ ID NO: 82728 - DNA, 21 bp, Homo sapiens
taggtgggggtggggtggggg

SEQ ID NO: 82729 - DNA, 23 bp, Homo sapiens
ggggagggggcggcgggcagggg

SEQ ID NO: 82730 - DNA, 19 bp, Homo sapiens
gggtgaggtggggcagggg

SEQ ID NO: 82731 - DNA, 18 bp, Homo sapiens
taggggcaggatatgggg

SEQ ID NO: 82732 - DNA, 22 bp, Homo sapiens
taggcgggggcaggggcagggg

SEQ ID NO: 82733 - DNA, 18 bp, Homo sapiens
taggggaagtgggtgggg

SEQ ID NO: 82734 - DNA, 23 bp, Homo sapiens
tagaggaagggtgtggtccctgg

SEQ ID NO: 82735 - DNA, 24 bp, Homo sapiens
taggtggtgtcagtggggcagggg

SEQ ID NO: 82736 - DNA, 19 bp, Homo sapiens
ggggaggcaggggtagggg

SEQ ID NO: 82737 - DNA, 23 bp, Homo sapiens
gggggcagggcttgaggcagggg

SEQ ID NO: 82738 - DNA, 20 bp, Homo sapiens
ggggggagctcgggcagggg

SEQ ID NO: 82739 - DNA, 19 bp, Homo sapiens
caggggaagggcagaaggg

SEQ ID NO: 82740 - DNA, 18 bp, Homo sapiens
tagggggacggggcaggg

SEQ ID NO: 82741 - DNA, 16 bp, Homo sapiens
taggggaggggcaggg

SEQ ID NO: 82742 - DNA, 23 bp, Homo sapiens
caggggatagaatggggcagggg

SEQ ID NO: 82743 - DNA, 18 bp, Homo sapiens
ggggaaggggatggtggg

SEQ ID NO: 82744 - DNA, 19 bp, Homo sapiens
gggggaggggtgacagggg

SEQ ID NO: 82745 - DNA, 23 bp, Homo sapiens
gggggggggggggcgggcagggg

SEQ ID NO: 82746 - DNA, 15 bp, Homo sapiens
aggggagggacagag

SEQ ID NO: 82747 - DNA, 18 bp, Homo sapiens
ggggggctgggggcaggg

SEQ ID NO: 82748 - DNA, 21 bp, Homo sapiens
gggtggaggaatgagcagggg

SEQ ID NO: 82749 - DNA, 21 bp, Homo sapiens
agggaagggtggcggtggggg

SEQ ID NO: 82750 - DNA, 16 bp, Homo sapiens
taggggaaggttgggg

SEQ ID NO: 82751 - DNA, 18 bp, Homo sapiens
caggggaaggcggtgggg

SEQ ID NO: 82752 - DNA, 20 bp, Homo sapiens
gggggaacgggtagcaaagg

SEQ ID NO: 82753 - DNA, 23 bp, Homo sapiens
taggggaaagttgggggtagggg

SEQ ID NO: 82754 - DNA, 21 bp, Homo sapiens
ggggaaagttgggggtagggg

SEQ ID NO: 82755 - DNA, 20 bp, Homo sapiens
gggggcgggcagggcagggg

SEQ ID NO: 82756 - DNA, 18 bp, Homo sapiens
ggggggcagggggcaggg

SEQ ID NO: 82757 - DNA, 23 bp, Homo sapiens
ggggaaggggcccagggcagggg

SEQ ID NO: 82758 - DNA, 21 bp, Homo sapiens
gggggcaggggtgggctgggg

SEQ ID NO: 82759 - DNA, 18 bp, Homo sapiens
caggggaatggggtgggg

SEQ ID NO: 82760 - DNA, 98 bp, Paramecium bursaria Chlorella virus 1
ccgtcgtcacagctggaaggacaccgttaatctggagcgttgaaatagtcttcagagcttccagttgttcgtaaatgtatgtgtagcgctgacgcagg

SEQ ID NO: 82761 - DNA, 24 bp, Paramecium bursaria Chlorella virus 1
gagcttccagttgttcgtaaatgt

SEQ ID NO: 82762 - DNA, 15 bp, Homo sapiens
gagcctccaggtaat

SEQ ID NO: 82763 - DNA, 24 bp, Homo sapiens
gagtttccagtttttctgctctgt

SEQ ID NO: 82764 - DNA, 21 bp, Homo sapiens
agccaggttgtttgtagatgt

SEQ ID NO: 82765 - DNA, 60 bp, Human herpesvirus 7
ggtgtctgaaagctcgccaaggtctcgcgtaaaagaacagatgtgaacttcagatgtacc

SEQ ID NO: 82766 - DNA, 24 bp, Human herpesvirus 7
tgaaagctcgccaaggtctcgcgt

SEQ ID NO: 82767 - DNA, 18 bp, Homo sapiens
tggaagttctcaaggccc

SEQ ID NO: 82768 - DNA, 18 bp, Homo sapiens
tgaaagctcctgaggtct

SEQ ID NO: 82769 - DNA, 22 bp, Homo sapiens
tgaaagctgggttttctcgtgt

SEQ ID NO: 82770 - DNA, 100 bp, Human herpesvirus 7
gatgtgaacttcagatgtaccaaccaaataatacgggttccgctataaaaagtgcacctctattcccgttcttatccccgttctaactcttccttgtatc

SEQ ID NO: 82771 - DNA, 24 bp, Human herpesvirus 7
aataatacgggttccgctataaaa

SEQ ID NO: 82772 - DNA, 23 bp, Homo sapiens
ataatattagcattgctataaaa

SEQ ID NO: 82773 - DNA, 60 bp, Human herpesvirus 6
cgattacgaatgccctggctattttaatgttattactagtaatttaccgggcgataatcg

SEQ ID NO: 82774 - DNA, 24 bp, Human herpesvirus 6
cctggctattttaatgttattact

SEQ ID NO: 82775 - DNA, 22 bp, Homo sapiens
ccaggctatttgttttattatt

SEQ ID NO: 82776 - DNA, 19 bp, Homo sapiens
cctggctaattattatatt

SEQ ID NO: 82777 - DNA, 19 bp, Homo sapiens
cctgccactgatgttatta

SEQ ID NO: 82778 - DNA, 19 bp, Homo sapiens
tggtaattttaatgccatt

SEQ ID NO: 82779 - DNA, 20 bp, Homo sapiens
gctcttttgatgttattact

SEQ ID NO: 82780 - DNA, 21 bp, Homo sapiens
ctggttcttttggtcatcact

SEQ ID NO: 82781 - DNA, 24 bp, Homo sapiens
cctggcagtgggaatgttattgct

SEQ ID NO: 82782 - DNA, 19 bp, Homo sapiens
cctggctatgattgttatt

SEQ ID NO: 82783 - DNA, 21 bp, Homo sapiens
cctggctaattttgtattatt

SEQ ID NO: 82784 - DNA, 25 bp, Homo sapiens
cctggctaattttttaaaaattatt

SEQ ID NO: 82785 - DNA, 19 bp, Homo sapiens
cctggctaatttttgtatt

SEQ ID NO: 82786 - DNA, 18 bp, Homo sapiens
tggcatttaaatgttatt

SEQ ID NO: 82787 - DNA, 20 bp, Homo sapiens
cctggctaatttttgttatt

SEQ ID NO: 82788 - DNA, 19 bp, Homo sapiens
cctggctattattattatt

SEQ ID NO: 82789 - DNA, 18 bp, Homo sapiens
cctggctattttgtagtt

SEQ ID NO: 82790 - DNA, 20 bp, Homo sapiens
tggctattttcatggttatt

SEQ ID NO: 82791 - DNA, 19 bp, Homo sapiens
ctggctattttattttatt

SEQ ID NO: 82792 - DNA, 19 bp, Homo sapiens
cctggctatttattttatt

SEQ ID NO: 82793 - DNA, 22 bp, Homo sapiens
cctggctaattttttaattatt

SEQ ID NO: 82794 - DNA, 20 bp, Homo sapiens
cctagctaactgttgttatt

SEQ ID NO: 82795 - DNA, 22 bp, Homo sapiens
ctggcaagggaatgttattgct

SEQ ID NO: 82796 - DNA, 20 bp, Homo sapiens
cctagctaattgttgttatt

SEQ ID NO: 82797 - DNA, 18 bp, Homo sapiens
tggctatttataaatgtt

SEQ ID NO: 82798 - DNA, 21 bp, Homo sapiens
ctggctatttctagaaatgct

SEQ ID NO: 82799 - DNA, 22 bp, Homo sapiens
cctggctaatttttgtattatt

SEQ ID NO: 82800 - DNA, 19 bp, Homo sapiens
cctggctattttgttatca

SEQ ID NO: 82801 - DNA, 21 bp, Homo sapiens
tggctattcctcattgttatt

SEQ ID NO: 82802 - DNA, 19 bp, Homo sapiens
cctggctaattttagtatt

SEQ ID NO: 82803 - DNA, 23 bp, Homo sapiens
tggcatattttagctaatttact

SEQ ID NO: 82804 - DNA, 20 bp, Homo sapiens
tggccattttgatgtgcact

SEQ ID NO: 82805 - DNA, 20 bp, Homo sapiens
tggataactatgttattact

SEQ ID NO: 82806 - DNA, 106 bp, Rice grassy stunt virus
tcttaagtattaactttaaatataattataaagattgtgtattcttcaacgacagaggagttctctatctactttataacagttttattaaagtttgttcttgcga

SEQ ID NO: 82807 - DNA, 24 bp, Rice grassy stunt virus
tataaagattgtgtattcttcaac

SEQ ID NO: 82808 - DNA, 19 bp, Homo sapiens
aaattgtgtattctttaac

SEQ ID NO: 82809 - DNA, 21 bp, Homo sapiens
taaaggtatgccttcttcaac

SEQ ID NO: 82810 - DNA, 20 bp, Homo sapiens
tataaagtttgaacattctt

SEQ ID NO: 82811 - DNA, 18 bp, Homo sapiens
aagaaaaatattcttcaa

SEQ ID NO: 82812 - DNA, 17 bp, Homo sapiens
tataaagacttgtattc

SEQ ID NO: 82813 - DNA, 19 bp, Homo sapiens
tataaagattgtggttcct

SEQ ID NO: 82814 - DNA, 22 bp, Homo sapiens
tacaaaaatttgtatttttcaa

SEQ ID NO: 82815 - DNA, 18 bp, Homo sapiens
agactgtgtgacctcaac

SEQ ID NO: 82816 - DNA, 18 bp, Homo sapiens
tatgaaggctgtgtattc

SEQ ID NO: 82817 - DNA, 17 bp, Homo sapiens
gaaaattattcttcaac

SEQ ID NO: 82818 - DNA, 19 bp, Homo sapiens
aagattgcctgacttcaac

SEQ ID NO: 82819 - DNA, 24 bp, Homo sapiens
tataaagatagtgccaaaatcaac

SEQ ID NO: 82820 - DNA, 22 bp, Homo sapiens
tataaaatttagtttcttcaac

SEQ ID NO: 82821 - DNA, 96 bp, Strawberry mild yellow edge virus
cgagtgctcacccccgaggagctcgccgcacccatctccgcagctagtaacaaggttgccactcgcgagcagattctcggcattgtagcggacttg

SEQ ID NO: 82822 - DNA, 24 bp, Strawberry mild yellow edge virus
ttgccactcgcgagcagattctcg

SEQ ID NO: 82823 - DNA, 19 bp, Homo sapiens
ctagcagggcagattttcg

SEQ ID NO: 82824 - DNA, 16 bp, Homo sapiens
ttgccacttgcagtct

SEQ ID NO: 82825 - DNA, 21 bp, Homo sapiens
ttgccacttgcaggcagagtc

SEQ ID NO: 82826 - DNA, 61 bp, Human herpesvirus 3
cacccacaaaggagtttgtaaaataaaatctctgtttagaccttaaaatttgttgtgtgtg

SEQ ID NO: 82827 - DNA, 24 bp, Human herpesvirus 3
aggagtttgtaaaataaaatctct

SEQ ID NO: 82828 - DNA, 16 bp, Homo sapiens
aggggttttaaaacct

SEQ ID NO: 82829 - DNA, 18 bp, Homo sapiens
gaagtttgtaaacaatct

SEQ ID NO: 82830 - DNA, 23 bp, Homo sapiens
gaagtttgatcttgaaaatctct

SEQ ID NO: 82831 - DNA, 16 bp, Homo sapiens
aggggtctgaaaatct

SEQ ID NO: 82832 - DNA, 19 bp, Homo sapiens
aaattctgtaaaataaaat

SEQ ID NO: 82833 - DNA, 23 bp, Homo sapiens
ggaggtctgctagtgaaatctct

SEQ ID NO: 82834 - DNA, 21 bp, Homo sapiens
aggagcttgtgggggctctct

SEQ ID NO: 82835 - DNA, 18 bp, Homo sapiens
aggggtttgcaagataaa

SEQ ID NO: 82836 - DNA, 21 bp, Homo sapiens
ggagtttgggaaggcatctct

SEQ ID NO: 82837 - DNA, 19 bp, Homo sapiens
aggaatttgtaaaatgctc

SEQ ID NO: 82838 - DNA, 23 bp, Homo sapiens
agaagtttgtgaataaaatttct

SEQ ID NO: 82839 - DNA, 79 bp, Human herpesvirus 1
gtgagtttgtggacccaaagccctcagagacaacgcgacaggccagtatggaccgtgatacttttatttattaactcac

SEQ ID NO: 82840 - DNA, 24 bp, Human herpesvirus 1
gtggacccaaagccctcagagaca

SEQ ID NO: 82841 - DNA, 19 bp, Homo sapiens
tggatccgtttcagagaca

SEQ ID NO: 82842 - DNA, 20 bp, Homo sapiens
ggggtccagagtcctcagag

SEQ ID NO: 82843 - DNA, 16 bp, Homo sapiens
atggacccgtcagaga

SEQ ID NO: 82844 - DNA, 20 bp, Homo sapiens
gcggacccgctccttcggag

SEQ ID NO: 82845 - DNA, 26 bp, Homo sapiens
gtggaccgaaagcccttagctagaca

SEQ ID NO: 82846 - DNA, 17 bp, Homo sapiens
ggacccaaagcaacaga

SEQ ID NO: 82847 - DNA, 20 bp, Homo sapiens
ggacccaaggtggaaagaca

SEQ ID NO: 82848 - DNA, 24 bp, Homo sapiens
gtgggcacagggggctcagagaca

SEQ ID NO: 82849 - DNA, 23 bp, Homo sapiens
tgggcctaaaagggacagagaca

SEQ ID NO: 82850 - DNA, 21 bp, Homo sapiens
gtggacccggggctcctggag

SEQ ID NO: 82851 - DNA, 18 bp, Homo sapiens
tgggcccaggcctcagag

SEQ ID NO: 82852 - DNA, 21 bp, Homo sapiens
gggtcttcagcctcagagaca

SEQ ID NO: 82853 - DNA, 19 bp, Homo sapiens
gactctactctcagagaca

SEQ ID NO: 82854 - DNA, 18 bp, Homo sapiens
gtggacccagacacagga

SEQ ID NO: 82855 - DNA, 16 bp, Homo sapiens
gtggccccaaagtcag

SEQ ID NO: 82856 - DNA, 17 bp, Homo sapiens
ggacccagaaacaagag

SEQ ID NO: 82857 - DNA, 18 bp, Homo sapiens
gtggccccaaagcttgac

SEQ ID NO: 82858 - DNA, 24 bp, Homo sapiens
gtggccccaatttcctcagagaca

SEQ ID NO: 82859 - DNA, 18 bp, Homo sapiens
tggactcagagccctcaa

SEQ ID NO: 82860 - DNA, 18 bp, Homo sapiens
tggactcagagcccccag

SEQ ID NO: 82861 - DNA, 24 bp, Homo sapiens
tggatccaaagacattcagaggca

SEQ ID NO: 82862 - DNA, 21 bp, Homo sapiens
ggcctatagggccctcagaga

SEQ ID NO: 82863 - DNA, 18 bp, Homo sapiens
gcgggtggccctcagagc

SEQ ID NO: 82864 - DNA, 22 bp, Homo sapiens
gtggacccaatagctgttcaga

SEQ ID NO: 82865 - DNA, 19 bp, Homo sapiens
gtggacccacagccttgag

SEQ ID NO: 82866 - DNA, 19 bp, Homo sapiens
gggttcaaggccctcagag

SEQ ID NO: 82867 - DNA, 16 bp, Homo sapiens
ggcccagagtcagaga

SEQ ID NO: 82868 - DNA, 22 bp, Homo sapiens
gtggtccaaagcccctccagga

SEQ ID NO: 82869 - DNA, 18 bp, Homo sapiens
gtcgactccctcagagac

SEQ ID NO: 82870 - DNA, 19 bp, Homo sapiens
gtggctccaaagccttgac

SEQ ID NO: 82871 - DNA, 19 bp, Homo sapiens
tggacccaaggcctctgca

SEQ ID NO: 82872 - DNA, 19 bp, Homo sapiens
ggacttaaagccccaagaa

SEQ ID NO: 82873 - DNA, 16 bp, Homo sapiens
tggactccctcagagc

SEQ ID NO: 82874 - DNA, 18 bp, Homo sapiens
tggatccaaagccctgag

SEQ ID NO: 82875 - DNA, 17 bp, Homo sapiens
ggacccaaagctctgac

SEQ ID NO: 82876 - DNA, 21 bp, Homo sapiens
gtaggccgttcctcagaggca

SEQ ID NO: 82877 - DNA, 18 bp, Homo sapiens
gtggacccagagcgccag

SEQ ID NO: 82878 - DNA, 26 bp, Homo sapiens
gtggacccgggtcccttcctggagac

SEQ ID NO: 82879 - DNA, 22 bp, Homo sapiens
gtggcgcccagaaacttggaga

SEQ ID NO: 82880 - DNA, 18 bp, Homo sapiens
ggatccacgctcagagac

SEQ ID NO: 82881 - DNA, 24 bp, Homo sapiens
tgggccctcttcccctcagaggca

SEQ ID NO: 82882 - DNA, 22 bp, Homo sapiens
gtggctcagagaaaccgagaca

SEQ ID NO: 82883 - DNA, 24 bp, Homo sapiens
gtgggttccgagtcctcaaagaca

SEQ ID NO: 82884 - DNA, 74 bp, Human herpesvirus 5
tgacgtggatactagtaaaaaaagtgcgtcaaagctcttagcgtgtgacgtggatactagtaaaagggacgtca

SEQ ID NO: 82885 - DNA, 24 bp, Human herpesvirus 5
tgacgtggatactagtaaaaggga

SEQ ID NO: 82886 - DNA, 19 bp, Homo sapiens
tgacgtggatggcagaggg

SEQ ID NO: 82887 - DNA, 21 bp, Homo sapiens
gatgtggatacatgtggaggg

SEQ ID NO: 82888 - DNA, 23 bp, Homo sapiens
tgactggatacttgtatggggga

SEQ ID NO: 82889 - DNA, 21 bp, Homo sapiens
tgacgtgggtgccagtctgga

SEQ ID NO: 82890 - DNA, 22 bp, Homo sapiens
tggcggggatgcctcaaaaggg

SEQ ID NO: 82891 - DNA, 21 bp, Homo sapiens
tgacgtgggcactcagcaggg

SEQ ID NO: 82892 - DNA, 21 bp, Homo sapiens
tgacgtgggtactgggtaggg

SEQ ID NO: 82893 - DNA, 20 bp, Homo sapiens
tggacaccttggtggaaggg

SEQ ID NO: 82894 - DNA, 21 bp, Homo sapiens
tgacacaagctagtgggaggg

SEQ ID NO: 82895 - DNA, 19 bp, Homo sapiens
tgacgtgaagtgtggaggg

SEQ ID NO: 82896 - DNA, 120 bp, Equine rhinovirus 3
taccccagatttacccgttaccctaaaattccctcccctttctcttcactcgccgaggccacgccgagtaggaccgagggtacagcgagtcttttagtttaaggtgttagatgtaaggta

SEQ ID NO: 82897 - DNA, 24 bp, Equine rhinovirus 3
cctaaaattccctcccctttctct

SEQ ID NO: 82898 - DNA, 20 bp, Homo sapiens
taaaagttcctttctcccct

SEQ ID NO: 82899 - DNA, 21 bp, Homo sapiens
cttaaactacctcctttctct

SEQ ID NO: 82900 - DNA, 19 bp, Homo sapiens
ctaggaattccctcccact

SEQ ID NO: 82901 - DNA, 23 bp, Homo sapiens
cccaggattccctcctgtcatct

SEQ ID NO: 82902 - DNA, 21 bp, Homo sapiens
cctagtaattccctcctccct

SEQ ID NO: 82903 - DNA, 20 bp, Homo sapiens
aaattccctctcccacccct

SEQ ID NO: 82904 - DNA, 22 bp, Homo sapiens
ttccccctttttttctttctct

SEQ ID NO: 82905 - DNA, 19 bp, Homo sapiens
ctaaaactctcctttctct

SEQ ID NO: 82906 - DNA, 22 bp, Homo sapiens
ctcaaattcccgctgcctttct

SEQ ID NO: 82907 - DNA, 27 bp, Homo sapiens
cctaggataccttctttctctttctct

SEQ ID NO: 82908 - DNA, 18 bp, Homo sapiens
aaattccctccttccact

SEQ ID NO: 82909 - DNA, 20 bp, Homo sapiens
ccaaaattctcttttccttc

SEQ ID NO: 82910 - DNA, 21 bp, Homo sapiens
cctagaatccttctctcccct

SEQ ID NO: 82911 - DNA, 18 bp, Homo sapiens
cccgcccccctccccttt

SEQ ID NO: 82912 - DNA, 22 bp, Homo sapiens
ccttgggtcactccctttctct

SEQ ID NO: 82913 - DNA, 20 bp, Homo sapiens
ccttccatctttccctttct

SEQ ID NO: 82914 - DNA, 20 bp, Homo sapiens
ttccttccttttctttctct

SEQ ID NO: 82915 - DNA, 20 bp, Homo sapiens
caaaatttcttctcccccct

SEQ ID NO: 82916 - DNA, 20 bp, Homo sapiens
cctcatcctttcctttctct

SEQ ID NO: 82917 - DNA, 18 bp, Homo sapiens
ttcttctcctctttctct

SEQ ID NO: 82918 - DNA, 20 bp, Homo sapiens
aattccttttctctttctct

SEQ ID NO: 82919 - DNA, 19 bp, Homo sapiens
aaaacagacccctttctct

SEQ ID NO: 82920 - DNA, 20 bp, Homo sapiens
ctgaaatccactctttctct

SEQ ID NO: 82921 - DNA, 18 bp, Homo sapiens
ccttaaatccttcccttt

SEQ ID NO: 82922 - DNA, 20 bp, Homo sapiens
cctagcattccctcttcccc

SEQ ID NO: 82923 - DNA, 17 bp, Homo sapiens
ctaaaattcctccttct

SEQ ID NO: 82924 - DNA, 29 bp, Homo sapiens
taaaattcctttagctcttcctttttcta

SEQ ID NO: 82925 - DNA, 15 bp, Homo sapiens
aaattccctccttcc

SEQ ID NO: 82926 - DNA, 19 bp, Homo sapiens
cccaaagttccctttccct

SEQ ID NO: 82927 - DNA, 23 bp, Homo sapiens
cctagaatccctctttccccttt

SEQ ID NO: 82928 - DNA, 20 bp, Homo sapiens
aatttccttccctttttcta

SEQ ID NO: 82929 - DNA, 17 bp, Homo sapiens
ccaaaattccctttctc

SEQ ID NO: 82930 - DNA, 16 bp, Homo sapiens
taaaatatcccttctc

SEQ ID NO: 82931 - DNA, 27 bp, Homo sapiens
cctactaagcaattcccttctctttct

SEQ ID NO: 82932 - DNA, 18 bp, Homo sapiens
aaattccctattccctct

SEQ ID NO: 82933 - DNA, 19 bp, Homo sapiens
cctaagattcccaccccct

SEQ ID NO: 82934 - DNA, 18 bp, Homo sapiens
ctaaaatgttctctcccc

SEQ ID NO: 82935 - DNA, 24 bp, Homo sapiens
cctgaggtccttcctccccgacct

SEQ ID NO: 82936 - DNA, 21 bp, Homo sapiens
cctgagactccctcccgctct

SEQ ID NO: 82937 - DNA, 20 bp, Homo sapiens
ctgaattcccttggccttct

SEQ ID NO: 82938 - DNA, 17 bp, Homo sapiens
ctggaattcccttttcc

SEQ ID NO: 82939 - DNA, 20 bp, Homo sapiens
ctacagttccttcctcctct

SEQ ID NO: 82940 - DNA, 24 bp, Homo sapiens
cccgaattctctcccctttctcta

SEQ ID NO: 82941 - DNA, 18 bp, Homo sapiens
ctaaaactttgctttctc

SEQ ID NO: 82942 - DNA, 22 bp, Homo sapiens
cctggaattctctaccttctct

SEQ ID NO: 82943 - DNA, 18 bp, Homo sapiens
ctaaagttccttcctcct

SEQ ID NO: 82944 - DNA, 24 bp, Homo sapiens
cccacccactcttcctctttctct

SEQ ID NO: 82945 - DNA, 23 bp, Homo sapiens
cctccttcccttctcctttctct

SEQ ID NO: 82946 - DNA, 21 bp, Homo sapiens
ctgcaatttcctctccccctt

SEQ ID NO: 82947 - DNA, 22 bp, Homo sapiens
cctggaattctcccccccttct

SEQ ID NO: 82948 - DNA, 19 bp, Homo sapiens
cctataattccttctcccc

SEQ ID NO: 82949 - DNA, 19 bp, Homo sapiens
cctaaaacctcaattttct

SEQ ID NO: 82950 - DNA, 19 bp, Homo sapiens
ctataatttcttcccctct

SEQ ID NO: 82951 - DNA, 20 bp, Homo sapiens
cctaaaattccattctatct

SEQ ID NO: 82952 - DNA, 19 bp, Homo sapiens
cctggggctccctccttcc

SEQ ID NO: 82953 - DNA, 21 bp, Homo sapiens
cctggaattctcctcccctct

SEQ ID NO: 82954 - DNA, 16 bp, Homo sapiens
taaaattcccttttct

SEQ ID NO: 82955 - DNA, 24 bp, Homo sapiens
ccttggggatccttctctttctct

SEQ ID NO: 82956 - DNA, 16 bp, Homo sapiens
ctaaaattctcccttt

SEQ ID NO: 82957 - DNA, 17 bp, Homo sapiens
cctaaaataccctttct

SEQ ID NO: 82958 - DNA, 23 bp, Homo sapiens
ccttaagcccttttcctttctct

SEQ ID NO: 82959 - DNA, 22 bp, Homo sapiens
cctggaatgcccttcctattct

SEQ ID NO: 82960 - DNA, 21 bp, Homo sapiens
tagaattccctgccccgccct

SEQ ID NO: 82961 - DNA, 22 bp, Homo sapiens
ctgaggatctctctctctctct

SEQ ID NO: 82962 - DNA, 20 bp, Homo sapiens
aattctcctcctctttctct

SEQ ID NO: 82963 - DNA, 24 bp, Homo sapiens
cctgggacttccctttctccctct

SEQ ID NO: 82964 - DNA, 23 bp, Homo sapiens
cctgaacaccctcccctttttct

SEQ ID NO: 82965 - DNA, 19 bp, Homo sapiens
ccaaaatatttcctttctc

SEQ ID NO: 82966 - DNA, 21 bp, Homo sapiens
cctatggaacctcctttctct

SEQ ID NO: 82967 - DNA, 23 bp, Homo sapiens
cctaacaattttttttccccctc

SEQ ID NO: 82968 - DNA, 22 bp, Homo sapiens
cccaaaattctttctccacttt

SEQ ID NO: 82969 - DNA, 21 bp, Homo sapiens
cccagagttcccttccccttc

SEQ ID NO: 82970 - DNA, 23 bp, Homo sapiens
ccactttttcctcctctttttct

SEQ ID NO: 82971 - DNA, 22 bp, Homo sapiens
ccttaagaccacctctttctct

SEQ ID NO: 82972 - DNA, 18 bp, Homo sapiens
cctaaggtccctctccct

SEQ ID NO: 82973 - DNA, 21 bp, Homo sapiens
aaatcactttcccctttctct

SEQ ID NO: 82974 - DNA, 24 bp, Homo sapiens
cctaaaatatcaccatctttctct

SEQ ID NO: 82975 - DNA, 24 bp, Homo sapiens
cctggactttcctggcctttctct

SEQ ID NO: 82976 - DNA, 20 bp, Homo sapiens
cctaaaattctcccctctct

SEQ ID NO: 82977 - DNA, 21 bp, Homo sapiens
cctcgggggtcccctttctct

SEQ ID NO: 82978 - DNA, 20 bp, Homo sapiens
ctagcattctcttccccctc

SEQ ID NO: 82979 - DNA, 22 bp, Homo sapiens
ccttcccttttcctctttctct

SEQ ID NO: 82980 - DNA, 21 bp, Homo sapiens
taaaattcccctcttgtttct

SEQ ID NO: 82981 - DNA, 18 bp, Homo sapiens
cctaaacccccctttctc

SEQ ID NO: 82982 - DNA, 21 bp, Homo sapiens
ccccctccttttcctttttct

SEQ ID NO: 82983 - DNA, 22 bp, Homo sapiens
cctccctccctcccttttttct

SEQ ID NO: 82984 - DNA, 20 bp, Homo sapiens
cctaaggctccctcctacct

SEQ ID NO: 82985 - DNA, 21 bp, Homo sapiens
cctgggactccctccccatct

SEQ ID NO: 82986 - DNA, 19 bp, Homo sapiens
cctaaaatgtctactttct

SEQ ID NO: 82987 - DNA, 18 bp, Homo sapiens
taaatattccctctcttc

SEQ ID NO: 82988 - DNA, 20 bp, Homo sapiens
cctggaatgcctttccccct

SEQ ID NO: 82989 - DNA, 20 bp, Homo sapiens
ctaaaattcccttttccccc

SEQ ID NO: 82990 - DNA, 20 bp, Homo sapiens
cctaaggttccactttcccc

SEQ ID NO: 82991 - DNA, 16 bp, Homo sapiens
cctgttcccccccttt

SEQ ID NO: 82992 - DNA, 24 bp, Homo sapiens
cctggggcttcccttccccaccct

SEQ ID NO: 82993 - DNA, 19 bp, Homo sapiens
cctgaaaatccctcattct

SEQ ID NO: 82994 - DNA, 19 bp, Homo sapiens
aaatcctttctctttctct

SEQ ID NO: 82995 - DNA, 16 bp, Homo sapiens
ctaaacttcccttctc

SEQ ID NO: 82996 - DNA, 21 bp, Homo sapiens
ccatgattcttttccctttct

SEQ ID NO: 82997 - DNA, 25 bp, Homo sapiens
cctaaatttcctttcccgcccctct

SEQ ID NO: 82998 - DNA, 19 bp, Homo sapiens
ctgcaaacccttcctttct

SEQ ID NO: 82999 - DNA, 20 bp, Homo sapiens
ctaaaattccttccaattct

SEQ ID NO: 83000 - DNA, 16 bp, Homo sapiens
taaaattttccccttc

SEQ ID NO: 83001 - DNA, 18 bp, Homo sapiens
tcctcctcttctttctct

SEQ ID NO: 83002 - DNA, 20 bp, Homo sapiens
cctgaaagtccttctccccc

SEQ ID NO: 83003 - DNA, 21 bp, Homo sapiens
ccaaccccctcccttttttct

SEQ ID NO: 83004 - DNA, 20 bp, Homo sapiens
ttccttctttccctttttct

SEQ ID NO: 83005 - DNA, 25 bp, Homo sapiens
cctggagtccttccctggagcctct

SEQ ID NO: 83006 - DNA, 99 bp, Fowlpox virus
ttatgttcttcatttgcacgttatacagctatcactatttgaaaccatggatcttctatgtcgaacgtgaagtcacgtagatacgaaatggaaatataa

SEQ ID NO: 83007 - DNA, 24 bp, Fowlpox virus
tatacagctatcactatttgaaac

SEQ ID NO: 83008 - DNA, 19 bp, Homo sapiens
catacggctatcactgaaa

SEQ ID NO: 83009 - DNA, 17 bp, Homo sapiens
tatacagccatcatgaa

SEQ ID NO: 83010 - DNA, 21 bp, Homo sapiens
tatacagctatttctccttaa

SEQ ID NO: 83011 - DNA, 20 bp, Homo sapiens
acagttatcaaaatctgaaa

SEQ ID NO: 83012 - DNA, 17 bp, Homo sapiens
tacacagctaattttga

SEQ ID NO: 83013 - DNA, 19 bp, Homo sapiens
caggcaccattatttgaaa

SEQ ID NO: 83014 - DNA, 16 bp, Homo sapiens
tacagctatattgaaa

SEQ ID NO: 83015 - DNA, 19 bp, Homo sapiens
catacagctacaagtttga

SEQ ID NO: 83016 - DNA, 21 bp, Homo sapiens
caagtctatcactgtttgaaa

SEQ ID NO: 83017 - DNA, 20 bp, Homo sapiens
catacactcatgctatttga

SEQ ID NO: 83018 - DNA, 17 bp, Homo sapiens
tacagccctatttgaaa

SEQ ID NO: 83019 - DNA, 20 bp, Homo sapiens
tatacagctgacatactgtg

SEQ ID NO: 83020 - DNA, 19 bp, Homo sapiens
tatacaaccatatttggaa

SEQ ID NO: 83021 - DNA, 19 bp, Homo sapiens
acagtcacttatttgaaac

SEQ ID NO: 83022 - DNA, 18 bp, Homo sapiens
aacatcactatttgaaac

SEQ ID NO: 83023 - DNA, 23 bp, Homo sapiens
tacatggaacccctatttgaaac

SEQ ID NO: 83024 - DNA, 19 bp, Homo sapiens
agcagtctatatttgaaac

SEQ ID NO: 83025 - DNA, 18 bp, Homo sapiens
tacagctatcatagctga

SEQ ID NO: 83026 - DNA, 70 bp, Fowlpox virus
tttacaaatattactaaatgctatccatgtttaataagctatacgttacatgatgtaggtattatgtaaa

SEQ ID NO: 83027 - DNA, 20 bp, Fowlpox virus
tgatgtaggtattatgtaaa

SEQ ID NO: 83028 - DNA, 18 bp, Homo sapiens
cgatgtatcacatgtaaa

SEQ ID NO: 83029 - DNA, 20 bp, Homo sapiens
tgaagtatgtaatatgtaaa

SEQ ID NO: 83030 - DNA, 19 bp, Homo sapiens
tgtgtatttggcattatgt

SEQ ID NO: 83031 - DNA, 21 bp, Homo sapiens
taatgtaggcatgattgtaaa

SEQ ID NO: 83032 - DNA, 17 bp, Homo sapiens
atgtacatatatgtaaa

SEQ ID NO: 83033 - DNA, 17 bp, Homo sapiens
taatgtagaacatgtaa

SEQ ID NO: 83034 - DNA, 18 bp, Homo sapiens
atgtagtgtacatgtaaa

SEQ ID NO: 83035 - DNA, 18 bp, Homo sapiens
gatgtagaagtatgtaaa

SEQ ID NO: 83036 - DNA, 19 bp, Homo sapiens
atgtaggcacatgtgtaaa

SEQ ID NO: 83037 - DNA, 22 bp, Homo sapiens
tgtgtaggaatttctatgtaaa

SEQ ID NO: 83038 - DNA, 21 bp, Homo sapiens
tgatgtagattcctttgtaaa

SEQ ID NO: 83039 - DNA, 19 bp, Homo sapiens
taatgtaggaattaatgta

SEQ ID NO: 83040 - DNA, 19 bp, Homo sapiens
tgatgtaggtattaataaa

SEQ ID NO: 83041 - DNA, 21 bp, Homo sapiens
tgttgtaggtttctctgtaaa

SEQ ID NO: 83042 - DNA, 17 bp, Homo sapiens
tgctgtaggtataccta

SEQ ID NO: 83043 - DNA, 19 bp, Homo sapiens
gatgtcaacattatgtaaa

SEQ ID NO: 83044 - DNA, 17 bp, Homo sapiens
tgattaggtatcataca

SEQ ID NO: 83045 - DNA, 17 bp, Homo sapiens
atgtaaatccatgtaaa

SEQ ID NO: 83046 - DNA, 18 bp, Homo sapiens
tgatataggaaatgtaaa

SEQ ID NO: 83047 - DNA, 17 bp, Homo sapiens
tgataaatattatgtaa

SEQ ID NO: 83048 - DNA, 17 bp, Homo sapiens
taatgtagcacaatgta

SEQ ID NO: 83049 - DNA, 16 bp, Homo sapiens
tgatgtaggatctgca

SEQ ID NO: 83050 - DNA, 18 bp, Homo sapiens
tgagtaggcttcatgtaa

SEQ ID NO: 83051 - DNA, 19 bp, Homo sapiens
tgcatggttattatgtaaa

SEQ ID NO: 83052 - DNA, 17 bp, Homo sapiens
tgagtgggatcatgtaa

SEQ ID NO: 83053 - DNA, 71 bp, Swinepox virus
tgagttaaattataataagctagttataagttataataagctattagctaatttattataaaaaataacca

SEQ ID NO: 83054 - DNA, 24 bp, Swinepox virus
taagctagttataagttataataa

SEQ ID NO: 83055 - DNA, 21 bp, Homo sapiens
taagtaagttataaattataa

SEQ ID NO: 83056 - DNA, 22 bp, Homo sapiens
taagctagtacttttataataa

SEQ ID NO: 83057 - DNA, 20 bp, Homo sapiens
agctagttctgaaataataa

SEQ ID NO: 83058 - DNA, 18 bp, Homo sapiens
accataataagttataat

SEQ ID NO: 83059 - DNA, 20 bp, Homo sapiens
gctagttatcaccctcataa

SEQ ID NO: 83060 - DNA, 23 bp, Homo sapiens
tgactagttactcagatataata

SEQ ID NO: 83061 - DNA, 19 bp, Homo sapiens
agctagttacaggcagtaa

SEQ ID NO: 83062 - DNA, 93 bp, Molluscum contagiosum virus
ggcaagtgcgcgtgcaggcgtgctcgcgtgcgccgccagcgggcccttagggcgcgtgcgcgtgcaagtgtgtgccgcccgcaggcccttgcc

SEQ ID NO: 83063 - DNA, 24 bp, Molluscum contagiosum virus
cgtgcaagtgtgtgccgcccgcag

SEQ ID NO: 83064 - DNA, 26 bp, Homo sapiens
gtgcatgtgtgtattcacgcctgcag

SEQ ID NO: 83065 - DNA, 19 bp, Homo sapiens
gtgtacgtgtgtgcacgcc

SEQ ID NO: 83066 - DNA, 22 bp, Homo sapiens
gtgcgtgtgtgtgcgtgtgcag

SEQ ID NO: 83067 - DNA, 18 bp, Homo sapiens
cgggccaggtgtgccgcc

SEQ ID NO: 83068 - DNA, 19 bp, Homo sapiens
gtgcgagtgtgtgcgcccg

SEQ ID NO: 83069 - DNA, 18 bp, Homo sapiens
gtgctgagtgtgtgtccg

SEQ ID NO: 83070 - DNA, 19 bp, Homo sapiens
gtgaagtgtgtgctgctac

SEQ ID NO: 83071 - DNA, 19 bp, Homo sapiens
cggcgagtgtggacgccgc

SEQ ID NO: 83072 - DNA, 20 bp, Homo sapiens
cgtgcaagtgtgtgggaggc

SEQ ID NO: 83073 - DNA, 18 bp, Homo sapiens
cgtgcgggtgggtgcgcc

SEQ ID NO: 83074 - DNA, 23 bp, Homo sapiens
cggcggtcggctgccgcccgcag

SEQ ID NO: 83075 - DNA, 22 bp, Homo sapiens
gtgcaggtgtgtgcacgtgcag

SEQ ID NO: 83076 - DNA, 22 bp, Homo sapiens
gtgcaagtggagtggcttgcag

SEQ ID NO: 83077 - DNA, 20 bp, Homo sapiens
gtgtgagtgtgtgtgtgcag

SEQ ID NO: 83078 - DNA, 17 bp, Homo sapiens
tgcggcgcgccgcccgc

SEQ ID NO: 83079 - DNA, 23 bp, Homo sapiens
cgcgtagggggcgccgcctgcag

SEQ ID NO: 83080 - DNA, 22 bp, Homo sapiens
gtgcatgtgtgtgcgctcgcag

SEQ ID NO: 83081 - DNA, 15 bp, Homo sapiens
cgtgaagtgtgtggc

SEQ ID NO: 83082 - DNA, 18 bp, Homo sapiens
cgtgcagtgtgtgtccac

SEQ ID NO: 83083 - DNA, 16 bp, Homo sapiens
cgggcaagtgtcccgc

SEQ ID NO: 83084 - DNA, 18 bp, Homo sapiens
cgttagcccgccgcccgc

SEQ ID NO: 83085 - DNA, 20 bp, Homo sapiens
gtgcatgtgtgtgtgtgcag

SEQ ID NO: 83086 - DNA, 22 bp, Homo sapiens
gtgtatgtgcgcgagctcgcag

SEQ ID NO: 83087 - DNA, 23 bp, Homo sapiens
cgggcagccctggccgcccgcag

SEQ ID NO: 83088 - DNA, 21 bp, Homo sapiens
cgtgggagtgtgtgtgtgacc

SEQ ID NO: 83089 - DNA, 23 bp, Homo sapiens
cgtgccggggccctcgcccgcag

SEQ ID NO: 83090 - DNA, 116 bp, Melanoplus sanguinipes entomopoxvirus
tggataatatttttattaatgttaaaaaaaatttaataataatatgattagtataaataatcaaattatattaacagaatatgaaataatttttttttttttgaaaaattaatcca

SEQ ID NO: 83091 - DNA, 24 bp, Melanoplus sanguinipes entomopoxvirus
ttaacagaatatgaaataattttt

SEQ ID NO: 83092 - DNA, 22 bp, Homo sapiens
acaaatcactgaaataattttt

SEQ ID NO: 83093 - DNA, 19 bp, Homo sapiens
actagaatatgaaaaaatt

SEQ ID NO: 83094 - DNA, 20 bp, Homo sapiens
caggatgtgaaataattttt

SEQ ID NO: 83095 - DNA, 75 bp, Macaca mulatta rhadinovirus
gccgtagggctggcagggacggcacccagcagctattttcatctctagcgccgcctactagcggaaatctgcggt

SEQ ID NO: 83096 - DNA, 24 bp, Macaca mulatta rhadinovirus
gggctggcagggacggcacccagc

SEQ ID NO: 83097 - DNA, 19 bp, Homo sapiens
gggctggaggacggcccgg

SEQ ID NO: 83098 - DNA, 26 bp, Homo sapiens
ggcgctggcgggggcggccacggggc

SEQ ID NO: 83099 - DNA, 18 bp, Homo sapiens
ggactggcgggacctggc

SEQ ID NO: 83100 - DNA, 21 bp, Homo sapiens
gggctgctgggaacacccagc

SEQ ID NO: 83101 - DNA, 21 bp, Homo sapiens
gggtggcaccacgcgctcagc

SEQ ID NO: 83102 - DNA, 19 bp, Homo sapiens
gggctggctggggcgcggc

SEQ ID NO: 83103 - DNA, 22 bp, Homo sapiens
gggtggcagggaaggggtccag

SEQ ID NO: 83104 - DNA, 17 bp, Homo sapiens
gggctggcagggggcac

SEQ ID NO: 83105 - DNA, 18 bp, Homo sapiens
gggctggcgggagtgggc

SEQ ID NO: 83106 - DNA, 24 bp, Homo sapiens
gggctggcagggaatggtggcagc

SEQ ID NO: 83107 - DNA, 19 bp, Homo sapiens
gggctggcagggtgggggc

SEQ ID NO: 83108 - DNA, 18 bp, Homo sapiens
gggctcgcagggaccagc

SEQ ID NO: 83109 - DNA, 17 bp, Homo sapiens
gggcggcaggggtggca

SEQ ID NO: 83110 - DNA, 21 bp, Homo sapiens
gggccggcgggggctcgcggc

SEQ ID NO: 83111 - DNA, 21 bp, Homo sapiens
gggctggcgcgggcgggtagc

SEQ ID NO: 83112 - DNA, 25 bp, Homo sapiens
gggctgacggggggacaacttcagc

SEQ ID NO: 83113 - DNA, 21 bp, Homo sapiens
gggccggcagtccctgcccag

SEQ ID NO: 83114 - DNA, 18 bp, Homo sapiens
ggcctggcaggggtcagc

SEQ ID NO: 83115 - DNA, 21 bp, Homo sapiens
ggactggccacggcgctcagc

SEQ ID NO: 83116 - DNA, 22 bp, Homo sapiens
gggtggtggggccacacttagc

SEQ ID NO: 83117 - DNA, 23 bp, Homo sapiens
gggctggcggaggcggctcgagc

SEQ ID NO: 83118 - DNA, 19 bp, Homo sapiens
gggctggcgtggggcgcag

SEQ ID NO: 83119 - DNA, 17 bp, Homo sapiens
gggtggcaggggccccg

SEQ ID NO: 83120 - DNA, 20 bp, Homo sapiens
gggctggcgaggactgtggc

SEQ ID NO: 83121 - DNA, 20 bp, Homo sapiens
aggctggcgggggcccgggc

SEQ ID NO: 83122 - DNA, 19 bp, Homo sapiens
gggtggcagggagcctggc

SEQ ID NO: 83123 - DNA, 21 bp, Homo sapiens
gggccggcagggggagttggc

SEQ ID NO: 83124 - DNA, 18 bp, Homo sapiens
gggctggcagtggtgggc

SEQ ID NO: 83125 - DNA, 21 bp, Homo sapiens
gggttagcagggagggttggc

SEQ ID NO: 83126 - DNA, 21 bp, Homo sapiens
gggctgacgggggaagctggc

SEQ ID NO: 83127 - DNA, 22 bp, Homo sapiens
gggctggcgggacgggacgcag

SEQ ID NO: 83128 - DNA, 18 bp, Homo sapiens
gggctagcagggcccggc

SEQ ID NO: 83129 - DNA, 20 bp, Homo sapiens
gggttggagggagattcagc

SEQ ID NO: 83130 - DNA, 21 bp, Homo sapiens
gggctggcagggcgagatggc

SEQ ID NO: 83131 - DNA, 23 bp, Homo sapiens
gggctggcggcggtggcgacggc

SEQ ID NO: 83132 - DNA, 26 bp, Homo sapiens
gggccggcaggggcagcgggtccggc

SEQ ID NO: 83133 - DNA, 21 bp, Homo sapiens
gggtgggcagaaagcacccag

SEQ ID NO: 83134 - DNA, 18 bp, Homo sapiens
gggctggagggagtcagc

SEQ ID NO: 83135 - DNA, 21 bp, Homo sapiens
gggcggcagggagcgcctagc

SEQ ID NO: 83136 - DNA, 26 bp, Homo sapiens
aggttggcagggaggaccgacctggc

SEQ ID NO: 83137 - DNA, 19 bp, Homo sapiens
gggctggcaggtggtcagc

SEQ ID NO: 83138 - DNA, 20 bp, Homo sapiens
gggctggcgggcgagccggc

SEQ ID NO: 83139 - DNA, 18 bp, Homo sapiens
gggctggcggaggcggca

SEQ ID NO: 83140 - DNA, 20 bp, Homo sapiens
gggctggcaggggaggaggc

SEQ ID NO: 83141 - DNA, 23 bp, Homo sapiens
gggctggggacggcgcgcctagc

SEQ ID NO: 83142 - DNA, 19 bp, Homo sapiens
gggctgcagggacctgggc

SEQ ID NO: 83143 - DNA, 18 bp, Homo sapiens
gggctggcagggatgagc

SEQ ID NO: 83144 - DNA, 22 bp, Homo sapiens
gggctcgcagggacaggatggc

SEQ ID NO: 83145 - DNA, 19 bp, Homo sapiens
gggctggcagggactgagc

SEQ ID NO: 83146 - DNA, 20 bp, Homo sapiens
gctggcagggacaggacagc

SEQ ID NO: 83147 - DNA, 18 bp, Homo sapiens
ggcatggtgggcacccag

SEQ ID NO: 83148 - DNA, 21 bp, Homo sapiens
gggatggcaggaaggcccggc

SEQ ID NO: 83149 - DNA, 23 bp, Homo sapiens
gggctggcgcgggcttcgccggc

SEQ ID NO: 83150 - DNA, 23 bp, Homo sapiens
gggctggcaggaagacaaccagc

SEQ ID NO: 83151 - DNA, 22 bp, Homo sapiens
ggcctggcaggggacttttggc

SEQ ID NO: 83152 - DNA, 24 bp, Homo sapiens
gggcttggtcttcgggtgcccagc

SEQ ID NO: 83153 - DNA, 19 bp, Homo sapiens
gggcaccagggcacctggc

SEQ ID NO: 83154 - DNA, 16 bp, Homo sapiens
aggctggcaccagcac

SEQ ID NO: 83155 - DNA, 18 bp, Homo sapiens
aggctgggtggcacccag

SEQ ID NO: 83156 - DNA, 15 bp, Homo sapiens
gggtggcagggggca

SEQ ID NO: 83157 - DNA, 23 bp, Homo sapiens
gggctggcgagggtgcgcccggc

SEQ ID NO: 83158 - DNA, 18 bp, Homo sapiens
gggctggccgggccccag

SEQ ID NO: 83159 - DNA, 18 bp, Homo sapiens
gggcggcggggctacccg

SEQ ID NO: 83160 - DNA, 22 bp, Homo sapiens
gggctggcaggtagatgtcagc

SEQ ID NO: 83161 - DNA, 18 bp, Homo sapiens
gggctggctgggcacagc

SEQ ID NO: 83162 - DNA, 22 bp, Homo sapiens
gggctggcggggcacctcccag

SEQ ID NO: 83163 - DNA, 18 bp, Homo sapiens
gggccggcactgcacctg

SEQ ID NO: 83164 - DNA, 15 bp, Homo sapiens
gggctgggggaccca

SEQ ID NO: 83165 - DNA, 22 bp, Homo sapiens
gggcgccgggacggcactcggc

SEQ ID NO: 83166 - DNA, 22 bp, Homo sapiens
gggctgctgagctggcacccag

SEQ ID NO: 83167 - DNA, 19 bp, Homo sapiens
gggctggcagaggctcggc

SEQ ID NO: 83168 - DNA, 18 bp, Homo sapiens
gggcggcaggggtgggag

SEQ ID NO: 83169 - DNA, 22 bp, Homo sapiens
aggctggcggggatgcgcgggc

SEQ ID NO: 83170 - DNA, 23 bp, Homo sapiens
gggctgtggcgtgtgcacccggc

SEQ ID NO: 83171 - DNA, 23 bp, Homo sapiens
gggctggcaggagtggtgtcggc

SEQ ID NO: 83172 - DNA, 19 bp, Homo sapiens
gggctggcggggcttcggc

SEQ ID NO: 83173 - DNA, 19 bp, Homo sapiens
gggctggccggggcctcag

SEQ ID NO: 83174 - DNA, 18 bp, Homo sapiens
gggtggcaggggttcagc

SEQ ID NO: 83175 - DNA, 19 bp, Homo sapiens
gggcggcaggggcgcgggc

SEQ ID NO: 83176 - DNA, 22 bp, Homo sapiens
gggcaggcgggggctccgcagc

SEQ ID NO: 83177 - DNA, 17 bp, Homo sapiens
gggctggccagcacctg

SEQ ID NO: 83178 - DNA, 17 bp, Homo sapiens
gggtggcaggggcggca

SEQ ID NO: 83179 - DNA, 21 bp, Homo sapiens
gggctgttgttgggcacccag

SEQ ID NO: 83180 - DNA, 18 bp, Homo sapiens
gggctggctgggccaccc

SEQ ID NO: 83181 - DNA, 18 bp, Homo sapiens
ggactggcagggactggc

SEQ ID NO: 83182 - DNA, 18 bp, Homo sapiens
gggccggcgggggtcggc

SEQ ID NO: 83183 - DNA, 21 bp, Homo sapiens
gggctggcgtggacgcagagc

SEQ ID NO: 83184 - DNA, 23 bp, Homo sapiens
gggccggcaggggaaggcccagc

SEQ ID NO: 83185 - DNA, 20 bp, Homo sapiens
gctggcagcactcgcccagc

SEQ ID NO: 83186 - DNA, 25 bp, Homo sapiens
ggcgctggagatcacggcatccagc

SEQ ID NO: 83187 - DNA, 21 bp, Homo sapiens
gggccggcgggagggtccggc

SEQ ID NO: 83188 - DNA, 18 bp, Homo sapiens
gggctgggaggacccggc

SEQ ID NO: 83189 - DNA, 21 bp, Homo sapiens
ggactggcatgggcgcctggc

SEQ ID NO: 83190 - DNA, 21 bp, Homo sapiens
gggccggcgggggcctccagc

SEQ ID NO: 83191 - DNA, 21 bp, Homo sapiens
ggttggcagggcgtgcccagc

SEQ ID NO: 83192 - DNA, 21 bp, Homo sapiens
gagctggcaggggactcccag

SEQ ID NO: 83193 - DNA, 19 bp, Homo sapiens
gggctggcggggaccccgc

SEQ ID NO: 83194 - DNA, 19 bp, Homo sapiens
ggcaggcgagggcgcccag

SEQ ID NO: 83195 - DNA, 24 bp, Homo sapiens
gggtgggcggggacggccgccagc

SEQ ID NO: 83196 - DNA, 23 bp, Homo sapiens
gggttgctggataaacacccagc

SEQ ID NO: 83197 - DNA, 19 bp, Homo sapiens
aggctggcagggccctggc

SEQ ID NO: 83198 - DNA, 27 bp, Homo sapiens
gggctagcagggggctgagcacccagc

SEQ ID NO: 83199 - DNA, 24 bp, Homo sapiens
gggcgggcgggctggctgtccagc

SEQ ID NO: 83200 - DNA, 22 bp, Homo sapiens
gggttgctgcctggcacccagc

SEQ ID NO: 83201 - DNA, 20 bp, Homo sapiens
ggcttggcagggatgcaggc

SEQ ID NO: 83202 - DNA, 19 bp, Homo sapiens
gggtgggcagaaagcaccc

SEQ ID NO: 83203 - DNA, 19 bp, Homo sapiens
gggtctggcaggcacccag

SEQ ID NO: 83204 - DNA, 19 bp, Homo sapiens
gggctggtaggggactcag

SEQ ID NO: 83205 - DNA, 18 bp, Homo sapiens
gggttggcaggagcagca

SEQ ID NO: 83206 - DNA, 19 bp, Homo sapiens
aggctggcatagtgcccag

SEQ ID NO: 83207 - DNA, 15 bp, Homo sapiens
gggtggcagggccca

SEQ ID NO: 83208 - DNA, 15 bp, Homo sapiens
gggcggcaggaccca

SEQ ID NO: 83209 - DNA, 18 bp, Homo sapiens
aggctggcaggggcccca

SEQ ID NO: 83210 - DNA, 18 bp, Homo sapiens
gggctggcggcgggcggc

SEQ ID NO: 83211 - DNA, 21 bp, Homo sapiens
gggctggcagggagcaagagc

SEQ ID NO: 83212 - DNA, 22 bp, Homo sapiens
gggctggcgggggccggggagc

SEQ ID NO: 83213 - DNA, 20 bp, Homo sapiens
gggttgggcagaaagcaccc

SEQ ID NO: 83214 - DNA, 21 bp, Homo sapiens
gggcggcagggcgagactcag

SEQ ID NO: 83215 - DNA, 74 bp, Pea seed-borne mosaic virus
ttctagggttctattatcatcaattccatagtgagtctttgacttcggtttggtggcagtagggctttctggag

SEQ ID NO: 83216 - DNA, 24 bp, Pea seed-borne mosaic virus
tagggttctattatcatcaattcc

SEQ ID NO: 83217 - DNA, 17 bp, Homo sapiens
agggttctatggcaatt

SEQ ID NO: 83218 - DNA, 21 bp, Homo sapiens
tagagtccaatcatcagttcc

SEQ ID NO: 83219 - DNA, 16 bp, Homo sapiens
ggattctgatcaattc

SEQ ID NO: 83220 - DNA, 22 bp, Homo sapiens
taggattttattgtcaccctcc

SEQ ID NO: 83221 - DNA, 18 bp, Homo sapiens
gaggtaccatcatcaatt

SEQ ID NO: 83222 - DNA, 19 bp, Homo sapiens
tagagttggttcatcaatt

SEQ ID NO: 83223 - DNA, 22 bp, Homo sapiens
tagggattcagtctcatcgatt

SEQ ID NO: 83224 - DNA, 76 bp, Satellite virus of maize white line mosaic virus
tctgaacactttcttgaaagttgcggctgaccaccgtacaggaattctctcgcactagtcgggtttgaagcgcggg

SEQ ID NO: 83225 - DNA, 24 bp, Satellite virus of maize white line mosaic virus
ttgaaagttgcggctgaccaccgt

SEQ ID NO: 83226 - DNA, 24 bp, Homo sapiens
ttggcaggaatcgctgaccactgt

SEQ ID NO: 83227 - DNA, 21 bp, Homo sapiens
ctgggagttgcagatcactgt

SEQ ID NO: 83228 - DNA, 19 bp, Homo sapiens
ttgggagctgggaccaccg

SEQ ID NO: 83229 - DNA, 20 bp, Homo sapiens
ttggaggtgtggctggtcac

SEQ ID NO: 83230 - DNA, 21 bp, Homo sapiens
tgggagttgcgggcaggccgt

SEQ ID NO: 83231 - DNA, 72 bp, Gallid herpesvirus 2
ctttcgtgaggacctgtaagtatgtcatggagtgggagggttcatttatattgcatgtaagccttatagagg

SEQ ID NO: 83232 - DNA, 22 bp, Gallid herpesvirus 2
ttgcatgtaagccttatagagg

SEQ ID NO: 83233 - DNA, 18 bp, Homo sapiens
ttgcatgtgagcaaacag

SEQ ID NO: 83234 - DNA, 20 bp, Homo sapiens
ttgcacgtgggcttcgaagg

SEQ ID NO: 83235 - DNA, 22 bp, Homo sapiens
atgtaataacgccttatagagg

SEQ ID NO: 83236 - DNA, 18 bp, Homo sapiens
ttgtgtgtaaacctacag

SEQ ID NO: 83237 - DNA, 21 bp, Homo sapiens
ttgcatgtggcatcagagagg

SEQ ID NO: 83238 - DNA, 19 bp, Homo sapiens
ttgcatgtaagcatcctag

SEQ ID NO: 83239 - DNA, 22 bp, Homo sapiens
ttgcatgtggtcggcatggagg

SEQ ID NO: 83240 - DNA, 24 bp, Homo sapiens
ttgcatgtaacttttttattgagg

SEQ ID NO: 83241 - DNA, 23 bp, Homo sapiens
ttacatgcacattttttataggg

SEQ ID NO: 83242 - DNA, 22 bp, Homo sapiens
ttgatgtaagcccctggcaggg

SEQ ID NO: 83243 - DNA, 19 bp, Homo sapiens
ttgcatgtggtcgtaaagg

SEQ ID NO: 83244 - DNA, 19 bp, Homo sapiens
ttgcatgcaagctgtaagg

SEQ ID NO: 83245 - DNA, 17 bp, Homo sapiens
ttacatgtaggccagag

SEQ ID NO: 83246 - DNA, 19 bp, Homo sapiens
actgtaagttttatagagg

SEQ ID NO: 83247 - DNA, 19 bp, Homo sapiens
gcgtgtgtcactatagagg

SEQ ID NO: 83248 - DNA, 17 bp, Homo sapiens
ttgcatgtggccaaaag

SEQ ID NO: 83249 - DNA, 20 bp, Homo sapiens
tgtaatgcttattatagagg

SEQ ID NO: 83250 - DNA, 16 bp, Homo sapiens
ttacatatttatagag

SEQ ID NO: 83251 - DNA, 19 bp, Homo sapiens
ttgcatataagtctggagg

SEQ ID NO: 83252 - DNA, 21 bp, Homo sapiens
ttgcatgttggcctcaggagg

SEQ ID NO: 83253 - DNA, 111 bp, Equine herpesvirus 4
tttctgtattttgtcaaatagtcattggtctgattaaaaaggtttaataaatgttttacatttatatttggccgactctgttcatattttactgtcgctgatatacggaaa

SEQ ID NO: 83254 - DNA, 24 bp, Equine herpesvirus 4
tattttgtcaaatagtcattggtc

SEQ ID NO: 83255 - DNA, 18 bp, Homo sapiens
tatcttgtcaaaattggt

SEQ ID NO: 83256 - DNA, 19 bp, Homo sapiens
tattttgtctaccattggt

SEQ ID NO: 83257 - DNA, 21 bp, Homo sapiens
tttgtcaattatcctgttggt

SEQ ID NO: 83258 - DNA, 24 bp, Homo sapiens
tattttgttggcagttcagttggt

SEQ ID NO: 83259 - DNA, 96 bp, African swine fever virus
tgttatcaaatgtactgtttaatacgcaaatggatttactacgttttaattgtatgtcttcatgtgcaggctctagtggatagtaattttctcaca

SEQ ID NO: 83260 - DNA, 24 bp, African swine fever virus
acgcaaatggatttactacgtttt

SEQ ID NO: 83261 - DNA, 19 bp, Homo sapiens
caaatgaaacttacgtttt

SEQ ID NO: 83262 - DNA, 23 bp, Homo sapiens
acacgtgacatttattacgtttt

SEQ ID NO: 83263 - DNA, 130 bp, Camelpox virus
tggtgctaattattcctatattatatttcacgaaaaatgatgaaggcaatcattcctcataagatgataaaaagtaagggtgtgataaaagtgtattgagagtgagtggagtgagtgagtgagagtatta

SEQ ID NO: 83264 - DNA, 24 bp, Camelpox virus
tatttcacgaaaaatgatgaaggc

SEQ ID NO: 83265 - DNA, 24 bp, Homo sapiens
tatttcacagaaatatcacagggc

SEQ ID NO: 83266 - DNA, 24 bp, Homo sapiens
tatttcactgaaaattcctgtagg

SEQ ID NO: 83267 - DNA, 23 bp, Homo sapiens
tattttacgaaaaagctaatggc

SEQ ID NO: 83268 - DNA, 23 bp, Homo sapiens
tatttcacagaaagtgttaaggc

SEQ ID NO: 83269 - DNA, 24 bp, Homo sapiens
tatttcactggggaatgatgaaga

SEQ ID NO: 83270 - DNA, 19 bp, Homo sapiens
ttcaaaaaaatgatggggg

SEQ ID NO: 83271 - DNA, 62 bp, Infectious spleen and kidney necrosis virus
ctatgcatactatgtgccccgcgatggcggctgtcgtcctgtagcagagtacgttcgcatgg

SEQ ID NO: 83272 - DNA, 21 bp, Infectious spleen and kidney necrosis virus
tagcagagtacgttcgcatgg

SEQ ID NO: 83273 - DNA, 18 bp, Homo sapiens
tagcagagagtcccatgg

SEQ ID NO: 83274 - DNA, 18 bp, Homo sapiens
cagcagagtgtgagctgg

SEQ ID NO: 83275 - DNA, 18 bp, Homo sapiens
cagcagagtcaagcatgg

SEQ ID NO: 83276 - DNA, 19 bp, Homo sapiens
gccagagtgcatcgcatgg

SEQ ID NO: 83277 - DNA, 17 bp, Homo sapiens
gcagagtaaatacatgg

SEQ ID NO: 83278 - DNA, 19 bp, Homo sapiens
tagcagaatgcccctaatg

SEQ ID NO: 83279 - DNA, 19 bp, Homo sapiens
cagcagagtgccccagtgg

SEQ ID NO: 83280 - DNA, 19 bp, Homo sapiens
tagcagagggcggccctgg

SEQ ID NO: 83281 - DNA, 17 bp, Homo sapiens
gcagagcagtggcatgg

SEQ ID NO: 83282 - DNA, 18 bp, Homo sapiens
agcaaagtgtttgcatgg

SEQ ID NO: 83283 - DNA, 18 bp, Homo sapiens
tagcagagttgtcagtgg

SEQ ID NO: 83284 - DNA, 20 bp, Homo sapiens
cagcagagtgggggctatgg

SEQ ID NO: 83285 - DNA, 20 bp, Homo sapiens
tagtggaaagcttcgcatgg

SEQ ID NO: 83286 - DNA, 19 bp, Homo sapiens
tagtggaatacgtacatgg

SEQ ID NO: 83287 - DNA, 21 bp, Homo sapiens
tagcaaagtgggcaggcgtgg

SEQ ID NO: 83288 - DNA, 18 bp, Homo sapiens
cagcagagtggggcatgg

SEQ ID NO: 83289 - DNA, 17 bp, Homo sapiens
gcagagcagccgtgtgg

SEQ ID NO: 83290 - DNA, 16 bp, Homo sapiens
tagcaggtaccacatg

SEQ ID NO: 83291 - DNA, 17 bp, Homo sapiens
gcagggcaatcgcatgg

SEQ ID NO: 83292 - DNA, 18 bp, Homo sapiens
tagcagagtgggcattgg

SEQ ID NO: 83293 - DNA, 19 bp, Homo sapiens
tagcagagcatcccagtgg

SEQ ID NO: 83294 - DNA, 18 bp, Homo sapiens
tagcagaggtgcgtgtgg

SEQ ID NO: 83295 - DNA, 17 bp, Homo sapiens
acagagtacagcagtgg

SEQ ID NO: 83296 - DNA, 66 bp, Infectious spleen and kidney necrosis virus
gtagtggatgtcctggaccatcgtggctacggctgcgtagtggatgtcatggaccatcgtggctac

SEQ ID NO: 83297 - DNA, 22 bp, Infectious spleen and kidney necrosis virus
tgtcatggaccatcgtggctac

SEQ ID NO: 83298 - DNA, 20 bp, Homo sapiens
tgtcatgggcattgtattac

SEQ ID NO: 83299 - DNA, 18 bp, Homo sapiens
tgtcatggagtggtgact

SEQ ID NO: 83300 - DNA, 20 bp, Homo sapiens
tgtatggaccaatactctac

SEQ ID NO: 83301 - DNA, 17 bp, Homo sapiens
tgtctatgctcgtggct

SEQ ID NO: 83302 - DNA, 20 bp, Homo sapiens
tgtcatggaattgtgcatac

SEQ ID NO: 83303 - DNA, 20 bp, Homo sapiens
tgccatgggctgccagggct

SEQ ID NO: 83304 - DNA, 16 bp, Homo sapiens
tgtctggaccacaacc

SEQ ID NO: 83305 - DNA, 18 bp, Homo sapiens
tgtctgggccacagctgc

SEQ ID NO: 83306 - DNA, 17 bp, Homo sapiens
tgccatggatcatatgc

SEQ ID NO: 83307 - DNA, 19 bp, Homo sapiens
tgtgtggaccactcactgc

SEQ ID NO: 83308 - DNA, 16 bp, Homo sapiens
tgtcatgatcatagcc

SEQ ID NO: 83309 - DNA, 18 bp, Homo sapiens
tgccatgggccacatgct

SEQ ID NO: 83310 - DNA, 19 bp, Homo sapiens
tgtcatgggacacccctac

SEQ ID NO: 83311 - DNA, 16 bp, Homo sapiens
tgtcaggaaatggcta

SEQ ID NO: 83312 - DNA, 20 bp, Homo sapiens
tgtcatggattttcaaaggc

SEQ ID NO: 83313 - DNA, 17 bp, Homo sapiens
tgtagtgcctcgtggct

SEQ ID NO: 83314 - DNA, 17 bp, Homo sapiens
tgtcatggagcagttgc

SEQ ID NO: 83315 - DNA, 21 bp, Homo sapiens
tgtcatggtagcaaagtggct

SEQ ID NO: 83316 - DNA, 17 bp, Homo sapiens
tgtcatggtctatgact

SEQ ID NO: 83317 - DNA, 19 bp, Homo sapiens
tgtctggaccatccctgac

SEQ ID NO: 83318 - DNA, 19 bp, Homo sapiens
tgtcatggaacatgtgact

SEQ ID NO: 83319 - DNA, 20 bp, Homo sapiens
tgtcatgattggtccagcta

SEQ ID NO: 83320 - DNA, 17 bp, Homo sapiens
tgtcatggatctggata

SEQ ID NO: 83321 - DNA, 21 bp, Homo sapiens
tgtcatggactacaatgatta

SEQ ID NO: 83322 - DNA, 16 bp, Homo sapiens
tgccatgggccaggcc

SEQ ID NO: 83323 - DNA, 20 bp, Homo sapiens
gccgccgccgtcgtggctac

SEQ ID NO: 83324 - DNA, 18 bp, Homo sapiens
tgtctgcccctcgtggct

SEQ ID NO: 83325 - DNA, 19 bp, Homo sapiens
tgccatgggccgtcagggc

SEQ ID NO: 83326 - DNA, 16 bp, Homo sapiens
tgtcatgaccgtgtgc

SEQ ID NO: 83327 - DNA, 20 bp, Homo sapiens
tgtgatgaaattgtggctac

SEQ ID NO: 83328 - DNA, 19 bp, Homo sapiens
tgacatggatcaaaaacta

SEQ ID NO: 83329 - DNA, 18 bp, Homo sapiens
tgtcatggtgccattcat

SEQ ID NO: 83330 - DNA, 22 bp, Homo sapiens
tgccatggacaccacaggctac

SEQ ID NO: 83331 - DNA, 19 bp, Homo sapiens
tgtcatggcactgtccaac

SEQ ID NO: 83332 - DNA, 20 bp, Homo sapiens
tgccatgggtttcgaaagct

SEQ ID NO: 83333 - DNA, 73 bp, Planococcus citri densovirus
gcgagtggtcgttgacgttgtggttgttttacgaagtaaaatatatagctatcaagtacagttctacttttgc

SEQ ID NO: 83334 - DNA, 24 bp, Planococcus citri densovirus
tatcaagtacagttctacttttgc

SEQ ID NO: 83335 - DNA, 24 bp, Homo sapiens
tatcaagagtagtgtgacttttgc

SEQ ID NO: 83336 - DNA, 18 bp, Homo sapiens
gtccacttctgcttttgc

SEQ ID NO: 83337 - DNA, 23 bp, Homo sapiens
cattgagtacagtggggatttgc

SEQ ID NO: 83338 - DNA, 23 bp, Homo sapiens
catcaagtatttactatttttgc

SEQ ID NO: 83339 - DNA, 19 bp, Homo sapiens
aagtctgctttacttttgc

SEQ ID NO: 83340 - DNA, 22 bp, Homo sapiens
taccaagcactttctacttttg

SEQ ID NO: 83341 - DNA, 18 bp, Homo sapiens
gctgagttcctacttttg

SEQ ID NO: 83342 - DNA, 21 bp, Homo sapiens
tcaagtacagtaagattttgc

SEQ ID NO: 83343 - DNA, 103 bp, Trichomonas vaginalis virus 3
ggcgacaggaagtctgtccaacctcattaccctttccaaagcaagtcggctaccataccgtaagctgagggaaggcgtgagagcgtcagactacaccgtcgcc

SEQ ID NO: 83344 - DNA, 24 bp, Trichomonas vaginalis virus 3
tgagggaaggcgtgagagcgtcag

SEQ ID NO: 83345 - DNA, 17 bp, Homo sapiens
tgagggaaggtggaaca

SEQ ID NO: 83346 - DNA, 19 bp, Homo sapiens
tgggggaaggctgactgca

SEQ ID NO: 83347 - DNA, 18 bp, Homo sapiens
tgggggagggcgcgagaa

SEQ ID NO: 83348 - DNA, 19 bp, Homo sapiens
tggggaaggggaagtgtca

SEQ ID NO: 83349 - DNA, 21 bp, Homo sapiens
tgagggaaggggtgaagagcg

SEQ ID NO: 83350 - DNA, 19 bp, Homo sapiens
tgagggaaggcggggacag

SEQ ID NO: 83351 - DNA, 23 bp, Homo sapiens
tgagagaagaagcagggtgtcag

SEQ ID NO: 83352 - DNA, 22 bp, Homo sapiens
tgggggaagggtgagagctcag

SEQ ID NO: 83353 - DNA, 17 bp, Homo sapiens
tgagggaaggctgggag

SEQ ID NO: 83354 - DNA, 17 bp, Homo sapiens
tggtggaaggcaaagcg

SEQ ID NO: 83355 - DNA, 62 bp, Alcelaphine herpesvirus 1
ctttttttttgtgaggctttgtataaattgttttttatataaaattgtaaataaaaaaacag

SEQ ID NO: 83356 - DNA, 24 bp, Alcelaphine herpesvirus 1
tataaaattgtaaataaaaaaaca

SEQ ID NO: 83357 - DNA, 20 bp, Homo sapiens
tataaaatgtaaataaaaaa

SEQ ID NO: 83358 - DNA, 20 bp, Homo sapiens
aaaactgccataaaaaaaca

SEQ ID NO: 83359 - DNA, 19 bp, Homo sapiens
taaaattgcaaacaagaaa

SEQ ID NO: 83360 - DNA, 93 bp, Variola virus
taatacttgactgacttaaaacttgataattaataatataattcgtttttatatgtgactattttaacgtctaaatgtattagttaaatatta

SEQ ID NO: 83361 - DNA, 24 bp, Variola virus
tacttgactgacttaaaacttgat

SEQ ID NO: 83362 - DNA, 23 bp, Homo sapiens
cttgactggcttggctgtgtgat

SEQ ID NO: 83363 - DNA, 21 bp, Homo sapiens
cactttcacttaaaacttgat

SEQ ID NO: 83364 - DNA, 17 bp, Homo sapiens
cttgacaataaaacttg

SEQ ID NO: 83365 - DNA, 19 bp, Homo sapiens
tacttggctacttaaaact

SEQ ID NO: 83366 - DNA, 19 bp, Homo sapiens
tgctgactggggaacttga

SEQ ID NO: 83367 - DNA, 63 bp, Sulfolobus virus SIRV-2
tagctactgaagataaagaagaagtaagaaaatctgaagtatttcaaaaagctttagaagttg

SEQ ID NO: 83368 - DNA, 24 bp, Sulfolobus virus SIRV-2
tatttcaaaaagctttagaagttg

SEQ ID NO: 83369 - DNA, 21 bp, Homo sapiens
tattttacaaaagctttgaag

SEQ ID NO: 83370 - DNA, 19 bp, Homo sapiens
tttcaaattatagaagttg

SEQ ID NO: 83371 - DNA, 23 bp, Homo sapiens
tttcaatgtagttttagaagttg

SEQ ID NO: 83372 - DNA, 23 bp, Homo sapiens
catttcaaggaaactggaagttg

SEQ ID NO: 83373 - DNA, 21 bp, Homo sapiens
tatttcaaaaatctcaagttg

SEQ ID NO: 83374 - DNA, 15 bp, Homo sapiens
tatttcaaaagaagt

SEQ ID NO: 83375 - DNA, 23 bp, Homo sapiens
catttcagaaacagatgaagttg

SEQ ID NO: 83376 - DNA, 22 bp, Homo sapiens
tatttcaaaaggtaaaaagttg

SEQ ID NO: 83377 - DNA, 66 bp, Infectious flacherie virus
tgcgacgtgtagaaccacttacaaaactttttgaaaggattgtttagctaggattcacgcgttgta

SEQ ID NO: 83378 - DNA, 24 bp, Infectious flacherie virus
aggattgtttagctaggattcacg

SEQ ID NO: 83379 - DNA, 16 bp, Homo sapiens
agattgtttggttcac

SEQ ID NO: 83380 - DNA, 19 bp, Homo sapiens
agaattgtttaaagattca

SEQ ID NO: 83381 - DNA, 16 bp, Homo sapiens
agggtccgctaggatt

SEQ ID NO: 83382 - DNA, 18 bp, Homo sapiens
agaattgtttgagcccag

SEQ ID NO: 83383 - DNA, 19 bp, Homo sapiens
gggttgtagaattaggatt

SEQ ID NO: 83384 - DNA, 19 bp, Homo sapiens
gggtgagctgggattcacg

SEQ ID NO: 83385 - DNA, 98 bp, Cowpox virus
taaaatataatattaatgtactaaaacttatatattattaatttatctaactaaagttagtaaattatatatataattttataattaatttaatttta

SEQ ID NO: 83386 - DNA, 24 bp, Cowpox virus
tataatattaatgtactaaaactt

SEQ ID NO: 83387 - DNA, 19 bp, Homo sapiens
taaatattaatgtccaaaa

SEQ ID NO: 83388 - DNA, 21 bp, Homo sapiens
tataatatcaatgccataaaa

SEQ ID NO: 83389 - DNA, 70 bp, Murid herpesvirus 4
tagcctcccacttttatggaaatctggtagctcctcctacatgagtcatgaaatgtcccttcaaaggctg

SEQ ID NO: 83390 - DNA, 24 bp, Murid herpesvirus 4
atgagtcatgaaatgtcccttcaa

SEQ ID NO: 83391 - DNA, 19 bp, Homo sapiens
atgaatcagctgttccttc

SEQ ID NO: 83392 - DNA, 19 bp, Homo sapiens
tgagctgactctgtccctt

SEQ ID NO: 83393 - DNA, 18 bp, Homo sapiens
tggcctgtgtctcttcaa

SEQ ID NO: 83394 - DNA, 25 bp, Homo sapiens
atgagctcatgaactcactcttcaa

SEQ ID NO: 83395 - DNA, 19 bp, Homo sapiens
gagtcttaaaatgtttctt

SEQ ID NO: 83396 - DNA, 25 bp, Homo sapiens
atgatcatgaataatgatttttcaa

SEQ ID NO: 83397 - DNA, 18 bp, Homo sapiens
catgaaaatgtcttttca

SEQ ID NO: 83398 - DNA, 17 bp, Homo sapiens
agtcatgaaacatttca

SEQ ID NO: 83399 - DNA, 16 bp, Homo sapiens
atgagtcaatgacctt

SEQ ID NO: 83400 - DNA, 20 bp, Homo sapiens
atgagaaaatgtcctttcaa

SEQ ID NO: 83401 - DNA, 21 bp, Homo sapiens
atgggttagaaatgccttcaa

SEQ ID NO: 83402 - DNA, 19 bp, Homo sapiens
atgtgtcatgaaatattca

SEQ ID NO: 83403 - DNA, 18 bp, Homo sapiens
tggtcatgaaaagcactt

SEQ ID NO: 83404 - DNA, 21 bp, Homo sapiens
ataagtcatgtatgtttttca

SEQ ID NO: 83405 - DNA, 19 bp, Homo sapiens
atgagtcagaagttcctca

SEQ ID NO: 83406 - DNA, 24 bp, Homo sapiens
tgagcaccttggatgtcccttcaa

SEQ ID NO: 83407 - DNA, 17 bp, Homo sapiens
atggccaagtgtccctt

SEQ ID NO: 83408 - DNA, 21 bp, Homo sapiens
atgagtcaggacatggcttca

SEQ ID NO: 83409 - DNA, 17 bp, Homo sapiens
taagtcatgtcttttca

SEQ ID NO: 83410 - DNA, 17 bp, Homo sapiens
agtgaaaatgtctcttc

SEQ ID NO: 83411 - DNA, 15 bp, Homo sapiens
gtcatgaaagtttca

SEQ ID NO: 83412 - DNA, 17 bp, Homo sapiens
atgaagtcctgtccctt

SEQ ID NO: 83413 - DNA, 90 bp, Trichomonas vaginalis virus 3
cgtctaggccacgtacagtctattgtcctcggaccctctgcctataggttaataggaatacagtgttactgttgtgtgtatcgctctagg

SEQ ID NO: 83414 - DNA, 24 bp, Trichomonas vaginalis virus 3
tacagtgttactgttgtgtgtatc

SEQ ID NO: 83415 - DNA, 18 bp, Homo sapiens
gtgtgtgcatgtgtgtat

SEQ ID NO: 83416 - DNA, 21 bp, Homo sapiens
gtgtgtgtgtgtgtgtgtatc

SEQ ID NO: 83417 - DNA, 16 bp, Homo sapiens
agtgttattgtgttgt

SEQ ID NO: 83418 - DNA, 19 bp, Homo sapiens
tacgtgtgtgtgtgtgtgt

SEQ ID NO: 83419 - DNA, 18 bp, Homo sapiens
tacactgttactgagtat

SEQ ID NO: 83420 - DNA, 18 bp, Homo sapiens
gtgtgtctgtgtgtgtgt

SEQ ID NO: 83421 - DNA, 19 bp, Homo sapiens
agtgtgtgtgtgtgtgtat

SEQ ID NO: 83422 - DNA, 16 bp, Homo sapiens
cagtgctgctgtgtgt

SEQ ID NO: 83423 - DNA, 18 bp, Homo sapiens
atgtctgtgtgtgtgtat

SEQ ID NO: 83424 - DNA, 18 bp, Homo sapiens
tacagtgtgctgtttggt

SEQ ID NO: 83425 - DNA, 19 bp, Homo sapiens
cagtgttacacgtgtgtgt

SEQ ID NO: 83426 - DNA, 18 bp, Homo sapiens
gtgtgtgtgtgtgtgtat

SEQ ID NO: 83427 - DNA, 18 bp, Homo sapiens
agtgtatggtgtgtgtat

SEQ ID NO: 83428 - DNA, 21 bp, Homo sapiens
tacagtttactgtttcatggt

SEQ ID NO: 83429 - DNA, 20 bp, Homo sapiens
gtgttattgttcttgtgtgt

SEQ ID NO: 83430 - DNA, 23 bp, Homo sapiens
gtgttacttgtgtgagtgtgtgt

SEQ ID NO: 83431 - DNA, 18 bp, Homo sapiens
gtgttgctgactctgtgt

SEQ ID NO: 83432 - DNA, 20 bp, Homo sapiens
tacagtgtaattgtgattgt

SEQ ID NO: 83433 - DNA, 18 bp, Homo sapiens
gtgtttgtgtgtgtgtgt

SEQ ID NO: 83434 - DNA, 20 bp, Homo sapiens
cagtgtgcgtacgtgtgtgt

SEQ ID NO: 83435 - DNA, 20 bp, Homo sapiens
gtgtgtgtgtgtgtgtgtat

SEQ ID NO: 83436 - DNA, 18 bp, Homo sapiens
cagtcttgctgcacgtat

SEQ ID NO: 83437 - DNA, 24 bp, Homo sapiens
tgagttctcattgttgtgtgtatc

SEQ ID NO: 83438 - DNA, 19 bp, Homo sapiens
gtgtgtgtgtgtgtgtatc

SEQ ID NO: 83439 - DNA, 16 bp, Homo sapiens
cagttcatgtgtgtgt

SEQ ID NO: 83440 - DNA, 18 bp, Homo sapiens
gtgtgtacatgtgtgtgt

SEQ ID NO: 83441 - DNA, 21 bp, Homo sapiens
tacagtgttattttttgctat

SEQ ID NO: 83442 - DNA, 18 bp, Homo sapiens
tacagtgttttgttttgt

SEQ ID NO: 83443 - DNA, 19 bp, Homo sapiens
tacaggttgttgcatgtat

SEQ ID NO: 83444 - DNA, 23 bp, Homo sapiens
tacagtgtggctgtggccagtat

SEQ ID NO: 83445 - DNA, 19 bp, Homo sapiens
agtgtgcgtgtgtgtgtgt

SEQ ID NO: 83446 - DNA, 22 bp, Homo sapiens
tacagtgatactgttgctgagt

SEQ ID NO: 83447 - DNA, 17 bp, Homo sapiens
gtgtgtgtgtgtgtatc

SEQ ID NO: 83448 - DNA, 16 bp, Homo sapiens
gtgtgtgtgtgtgtat

SEQ ID NO: 83449 - DNA, 78 bp, Ictalurid herpesvirus 1
agtgcggtggcgattgtatgtatcctcttatttcgggaatggacccgagtgtaagccggttcgaggcgccactaaact

SEQ ID NO: 83450 - DNA, 24 bp, Ictalurid herpesvirus 1
taagccggttcgaggcgccactaa

SEQ ID NO: 83451 - DNA, 18 bp, Homo sapiens
agctgttccaagaccact

SEQ ID NO: 83452 - DNA, 20 bp, Homo sapiens
tgagctgagatcgcgccact

SEQ ID NO: 83453 - DNA, 89 bp, Cowpox virus
tttttttaatggtgttgtggatgaggaatgaggaatgagagtgtcttatctagtcattggtttattacatggatcatcagagggagaaa

SEQ ID NO: 83454 - DNA, 24 bp, Cowpox virus
tgaggaatgaggaatgagagtgtc

SEQ ID NO: 83455 - DNA, 21 bp, Homo sapiens
tggggggtggggaaggaaagc

SEQ ID NO: 83456 - DNA, 19 bp, Homo sapiens
tggggagcgaggaatgaaa

SEQ ID NO: 83457 - DNA, 21 bp, Homo sapiens
aggtcggggggtgagagtgtc

SEQ ID NO: 83458 - DNA, 19 bp, Homo sapiens
tggggagtggggagatgag

SEQ ID NO: 83459 - DNA, 16 bp, Homo sapiens
tgagaaatggggagtg

SEQ ID NO: 83460 - DNA, 23 bp, Homo sapiens
tggggaggaggaatgggaaggtc

SEQ ID NO: 83461 - DNA, 22 bp, Homo sapiens
tgaggaatagggatataactgt

SEQ ID NO: 83462 - DNA, 18 bp, Homo sapiens
gaggaatggggaatggga

SEQ ID NO: 83463 - DNA, 23 bp, Homo sapiens
tgaggagtgatttctagagtgtc

SEQ ID NO: 83464 - DNA, 19 bp, Homo sapiens
aggaatctctgagagtgtc

SEQ ID NO: 83465 - DNA, 20 bp, Homo sapiens
gaggagtggggggaaaatgt

SEQ ID NO: 83466 - DNA, 18 bp, Homo sapiens
gaggaatgggggagatgt

SEQ ID NO: 83467 - DNA, 18 bp, Homo sapiens
gaggtgggtgaagagtgt

SEQ ID NO: 83468 - DNA, 19 bp, Homo sapiens
tggggaaagaggaacgtgt

SEQ ID NO: 83469 - DNA, 19 bp, Homo sapiens
aggaatgaggtatgggtgt

SEQ ID NO: 83470 - DNA, 18 bp, Homo sapiens
tgggggagaggaacatgt

SEQ ID NO: 83471 - DNA, 21 bp, Homo sapiens
tgagggagagagacagagtgt

SEQ ID NO: 83472 - DNA, 20 bp, Homo sapiens
tgagagtgggatgggagtgt

SEQ ID NO: 83473 - DNA, 18 bp, Homo sapiens
gagggatggggaaaatgt

SEQ ID NO: 83474 - DNA, 21 bp, Homo sapiens
tgaggaaggggagaaaatgtc

SEQ ID NO: 83475 - DNA, 71 bp, Lumpy skin disease virus
tgtgttgtttttaaaaaaagaaaaaaaaaggcattattttttctttttttttctttttttttaaaaatata

SEQ ID NO: 83476 - DNA, 24 bp, Lumpy skin disease virus
taaaaaaagaaaaaaaaaggcatt

SEQ ID NO: 83477 - DNA, 24 bp, Homo sapiens
taaaaaaaaaaaaagagagacatt

SEQ ID NO: 83478 - DNA, 18 bp, Homo sapiens
aaaaaaagaaaaaaaaaa

SEQ ID NO: 83479 - DNA, 18 bp, Homo sapiens
aaaaagaaaaaaaacagg

SEQ ID NO: 83480 - DNA, 21 bp, Homo sapiens
aaaaaagaaccaagaaaaggc

SEQ ID NO: 83481 - DNA, 21 bp, Homo sapiens
aaacaagaaaagaaaggcatt

SEQ ID NO: 83482 - DNA, 18 bp, Homo sapiens
taaaaaaagaaaaaaaaa

SEQ ID NO: 83483 - DNA, 20 bp, Homo sapiens
taaaaaaaaaaaaaaaaaaa

SEQ ID NO: 83484 - DNA, 22 bp, Homo sapiens
taaaaaaagaaaaaaacaaaca

SEQ ID NO: 83485 - DNA, 20 bp, Homo sapiens
aaaaagaaaagaaaaaggca

SEQ ID NO: 83486 - DNA, 19 bp, Homo sapiens
aaaaaaaaaaaaaaaacat

SEQ ID NO: 83487 - DNA, 19 bp, Homo sapiens
caaaaaaagaaaaaaaaag

SEQ ID NO: 83488 - DNA, 21 bp, Homo sapiens
aaaaagaaaaaaaaaggaatt

SEQ ID NO: 83489 - DNA, 18 bp, Homo sapiens
aaaaaaaaaaaaaaaagc

SEQ ID NO: 83490 - DNA, 18 bp, Homo sapiens
tgaaaaaaaaaaaaaagg

SEQ ID NO: 83491 - DNA, 18 bp, Homo sapiens
aaaaagaaaaaaaaaaca

SEQ ID NO: 83492 - DNA, 19 bp, Homo sapiens
aagaaaaaaaaaaaaaagc

SEQ ID NO: 83493 - DNA, 18 bp, Homo sapiens
aaaaaaaaaaaatagcat

SEQ ID NO: 83494 - DNA, 19 bp, Homo sapiens
aaaaaaaaaaaaaaaaaac

SEQ ID NO: 83495 - DNA, 20 bp, Homo sapiens
taaaaaaaaaaaaaaaaaag

SEQ ID NO: 83496 - DNA, 19 bp, Homo sapiens
aaaaaaaaaaaaaaaaagc

SEQ ID NO: 83497 - DNA, 21 bp, Homo sapiens
caaaaaaagagaaaaaaatgg

SEQ ID NO: 83498 - DNA, 18 bp, Homo sapiens
aaaagaaaaagaaggcat

SEQ ID NO: 83499 - DNA, 18 bp, Homo sapiens
aaaaaaagaaaaaaaagg

SEQ ID NO: 83500 - DNA, 20 bp, Homo sapiens
taaagaaagaaaaaaaaaag

SEQ ID NO: 83501 - DNA, 19 bp, Homo sapiens
aaaaaaagaaaaaaaaagg

SEQ ID NO: 83502 - DNA, 21 bp, Homo sapiens
caaaaaaagaaaaagaaaagc

SEQ ID NO: 83503 - DNA, 25 bp, Homo sapiens
taaaaacgagaaaaaaaactgcatt

SEQ ID NO: 83504 - DNA, 21 bp, Homo sapiens
taaaaaaaggaaaaaaaacac

SEQ ID NO: 83505 - DNA, 20 bp, Homo sapiens
aaaaaaagaaaaagaaaaac

SEQ ID NO: 83506 - DNA, 22 bp, Homo sapiens
aaaaaagtccaggaaaggcatt

SEQ ID NO: 83507 - DNA, 22 bp, Homo sapiens
aaaaaggaaaaaaaaacacact

SEQ ID NO: 83508 - DNA, 22 bp, Homo sapiens
aaaaaagaaaaaaatccacatt

SEQ ID NO: 83509 - DNA, 19 bp, Homo sapiens
aaaagagaaaaaagaaggc

SEQ ID NO: 83510 - DNA, 19 bp, Homo sapiens
caaaaaaggaaaaaaaaag

SEQ ID NO: 83511 - DNA, 18 bp, Homo sapiens
aaaaaaaaaaaaaagcca

SEQ ID NO: 83512 - DNA, 18 bp, Homo sapiens
tgaagaaggaaaaaggca

SEQ ID NO: 83513 - DNA, 20 bp, Homo sapiens
aaaaaaagaaaagaaaaaga

SEQ ID NO: 83514 - DNA, 19 bp, Homo sapiens
aaaaaaaaaaaaaaaaaag

SEQ ID NO: 83515 - DNA, 20 bp, Homo sapiens
aaaaagaaaaaaaaagacat

SEQ ID NO: 83516 - DNA, 21 bp, Homo sapiens
aaaaaaaaaaaaaaaggaatt

SEQ ID NO: 83517 - DNA, 24 bp, Homo sapiens
aaaaagaaaaaagaaaatagcatt

SEQ ID NO: 83518 - DNA, 18 bp, Homo sapiens
aaaaaaaaaaaaagcatc

SEQ ID NO: 83519 - DNA, 26 bp, Homo sapiens
aaaaaagggatggacaaaaaggcatt

SEQ ID NO: 83520 - DNA, 18 bp, Homo sapiens
aaaaaaaaaaaaaggaca

SEQ ID NO: 83521 - DNA, 21 bp, Homo sapiens
aaaaaaaaaaaaaaaggcatt

SEQ ID NO: 83522 - DNA, 22 bp, Homo sapiens
aaagaaaaaaaaaaaaggcatt

SEQ ID NO: 83523 - DNA, 17 bp, Homo sapiens
aaaaaagaaaaggaggc

SEQ ID NO: 83524 - DNA, 21 bp, Homo sapiens
tgaaaaaaaaaaaaaagcact

SEQ ID NO: 83525 - DNA, 19 bp, Homo sapiens
caaaaaaagaaaaaaaaaa

SEQ ID NO: 83526 - DNA, 20 bp, Homo sapiens
aaagaaagaaagaaaaaagc

SEQ ID NO: 83527 - DNA, 19 bp, Homo sapiens
aaaaaaaaaaaaaaaaaca

SEQ ID NO: 83528 - DNA, 21 bp, Homo sapiens
taaaaaaaaaaaaaaaaaaac

SEQ ID NO: 83529 - DNA, 17 bp, Homo sapiens
aaaagaaaaagtggcat

SEQ ID NO: 83530 - DNA, 28 bp, Homo sapiens
aaaaagaaaaaaaaaatcaaaggcatta

SEQ ID NO: 83531 - DNA, 19 bp, Homo sapiens
aaagaaagaaaaaaaaaga

SEQ ID NO: 83532 - DNA, 18 bp, Homo sapiens
aaaagaaaaaaaaaaagc

SEQ ID NO: 83533 - DNA, 18 bp, Homo sapiens
aaaaaaaaaaaaaaaaga

SEQ ID NO: 83534 - DNA, 20 bp, Homo sapiens
aaaggaaaaaagaaagcatt

SEQ ID NO: 83535 - DNA, 18 bp, Homo sapiens
aaaaaagaaaaaaaaaag

SEQ ID NO: 83536 - DNA, 19 bp, Homo sapiens
aaaaaaagaaaaaaaaaaa

SEQ ID NO: 83537 - DNA, 18 bp, Homo sapiens
aaaaaaaaaaaaaaaagg

SEQ ID NO: 83538 - DNA, 19 bp, Homo sapiens
caaaaaaagaaagaaaagc

SEQ ID NO: 83539 - DNA, 17 bp, Homo sapiens
taaaaaaagaaaaaagg

SEQ ID NO: 83540 - DNA, 21 bp, Homo sapiens
aaaaaagaaaaaaaaaaccat

SEQ ID NO: 83541 - DNA, 18 bp, Homo sapiens
aagaaaaagagaggcatt

SEQ ID NO: 83542 - DNA, 17 bp, Homo sapiens
aaaagaaaccaaggcat

SEQ ID NO: 83543 - DNA, 20 bp, Homo sapiens
aaaaaaaaaaaaaaagacac

SEQ ID NO: 83544 - DNA, 26 bp, Homo sapiens
aaaaaaagaaaaaagaaaaaaacatt

SEQ ID NO: 83545 - DNA, 18 bp, Homo sapiens
aaaaaaagaaaggaggca

SEQ ID NO: 83546 - DNA, 22 bp, Homo sapiens
taaaaaaagaaaaaaaaaggca

SEQ ID NO: 83547 - DNA, 19 bp, Homo sapiens
aaaaaaaaaaaaaaaaagg

SEQ ID NO: 83548 - DNA, 22 bp, Homo sapiens
aaaaaaaaaaaaaaaactcatt

SEQ ID NO: 83549 - DNA, 22 bp, Homo sapiens
tgaaaaaaaaaaaaaaaccatt

SEQ ID NO: 83550 - DNA, 17 bp, Homo sapiens
aaaaagacaaaaaaagc

SEQ ID NO: 83551 - DNA, 19 bp, Homo sapiens
aaaaaaagaaaggaaaagc

SEQ ID NO: 83552 - DNA, 18 bp, Homo sapiens
aaaaaaagaaaaaaaagc

SEQ ID NO: 83553 - DNA, 22 bp, Homo sapiens
taaaaacactaaaaaaggcatt

SEQ ID NO: 83554 - DNA, 22 bp, Homo sapiens
aaaaaaagaaaaaaaaaagaat

SEQ ID NO: 83555 - DNA, 21 bp, Homo sapiens
taaaaggagaaaaaaaaaaac

SEQ ID NO: 83556 - DNA, 22 bp, Homo sapiens
aaaaagaaaaagaaaaagcatt

SEQ ID NO: 83557 - DNA, 23 bp, Homo sapiens
taaaaacaagaaaaaaaaaaagc

SEQ ID NO: 83558 - DNA, 18 bp, Homo sapiens
aaaaaaagaaaaaaaaag

SEQ ID NO: 83559 - DNA, 22 bp, Homo sapiens
aaaaaaagaaaaacactgcatt

SEQ ID NO: 83560 - DNA, 20 bp, Homo sapiens
aaagaaggctaaaaggcatt

SEQ ID NO: 83561 - DNA, 20 bp, Homo sapiens
aaaaaagaaaaaaaaaacca

SEQ ID NO: 83562 - DNA, 19 bp, Homo sapiens
taaaaaaagaaaaagaaag

SEQ ID NO: 83563 - DNA, 22 bp, Homo sapiens
aaaaaagacaaagaagggcatt

SEQ ID NO: 83564 - DNA, 20 bp, Homo sapiens
aaaaaaagaaaaagaaaagc

SEQ ID NO: 83565 - DNA, 21 bp, Homo sapiens
tgaaagaaaaaggaaaaagca

SEQ ID NO: 83566 - DNA, 19 bp, Homo sapiens
aaaaaagaaatgaggcatt

SEQ ID NO: 83567 - DNA, 20 bp, Homo sapiens
aagaaaaggaaaaaagcatt

SEQ ID NO: 83568 - DNA, 23 bp, Homo sapiens
aaaaagacaaaaaacatagcatt

SEQ ID NO: 83569 - DNA, 16 bp, Homo sapiens
aaaaagaaaaaaggca

SEQ ID NO: 83570 - DNA, 19 bp, Homo sapiens
aaaaaaaaaaaaaagtcac

SEQ ID NO: 83571 - DNA, 18 bp, Homo sapiens
aaaaaaaaaaaaaggaac

SEQ ID NO: 83572 - DNA, 17 bp, Homo sapiens
aagaaaaaaaagacact

SEQ ID NO: 83573 - DNA, 18 bp, Homo sapiens
aaaaaaaaaaaaaaaaac

SEQ ID NO: 83574 - DNA, 20 bp, Homo sapiens
aaagaaaaatttgaggcatt

SEQ ID NO: 83575 - DNA, 20 bp, Homo sapiens
taaaaaaggaaaaaaaaaag

SEQ ID NO: 83576 - DNA, 18 bp, Homo sapiens
tgaaagaaaaaaaaaaac

SEQ ID NO: 83577 - DNA, 19 bp, Homo sapiens
aaaagaaagaaagaaggca

SEQ ID NO: 83578 - DNA, 24 bp, Homo sapiens
aaagaaagaaaaaaaaaagacatt

SEQ ID NO: 83579 - DNA, 19 bp, Homo sapiens
aaaaaaaaaaaaaaaagca

SEQ ID NO: 83580 - DNA, 21 bp, Homo sapiens
tgaaaaaaaaaaaacagcatt

SEQ ID NO: 83581 - DNA, 21 bp, Homo sapiens
aaaaaaagaaaagaaaaaagg

SEQ ID NO: 83582 - DNA, 20 bp, Homo sapiens
tgaaaaaaaaaaaaaaggca

SEQ ID NO: 83583 - DNA, 19 bp, Homo sapiens
aaaaaaagaagaaaaaagc

SEQ ID NO: 83584 - DNA, 18 bp, Homo sapiens
tgaaaaaaaaaaaaaggc

SEQ ID NO: 83585 - DNA, 17 bp, Homo sapiens
aaaaaagaaaaaaaagg

SEQ ID NO: 83586 - DNA, 19 bp, Homo sapiens
aaaaaaagaaaagaaaaga

SEQ ID NO: 83587 - DNA, 25 bp, Homo sapiens
aaaagaagaaaaaaaaatgtgcatt

SEQ ID NO: 83588 - DNA, 19 bp, Homo sapiens
aaagaggaaaaaaagcact

SEQ ID NO: 83589 - DNA, 21 bp, Homo sapiens
taaaataagaaaaaaaaaggc

SEQ ID NO: 83590 - DNA, 23 bp, Homo sapiens
taaaaaaagacaaaaaaaaaagc

SEQ ID NO: 83591 - DNA, 19 bp, Homo sapiens
taaaaaaaggaaaaaaaag

SEQ ID NO: 83592 - DNA, 18 bp, Homo sapiens
aaagagaaataaaggcat

SEQ ID NO: 83593 - DNA, 18 bp, Homo sapiens
aaagagaaaaaaaaaagc

SEQ ID NO: 83594 - DNA, 20 bp, Homo sapiens
aaagaaagaaaagaaggcac

SEQ ID NO: 83595 - DNA, 18 bp, Homo sapiens
tgaaaaagaaaaaaaaag

SEQ ID NO: 83596 - DNA, 20 bp, Homo sapiens
aaaaaaaaaaaaaaaaaaac

SEQ ID NO: 83597 - DNA, 23 bp, Homo sapiens
tgaaaaaaaaaaaaaaagacatt

SEQ ID NO: 83598 - DNA, 20 bp, Homo sapiens
taaaaaaagaaaaaaaaaag

SEQ ID NO: 83599 - DNA, 22 bp, Homo sapiens
aaaaaaaaaaaaaaaaagcatt

SEQ ID NO: 83600 - DNA, 24 bp, Homo sapiens
taaaaaaaaaaaaaaacccacatt

SEQ ID NO: 83601 - DNA, 19 bp, Homo sapiens
aaaaaaaaaaaaaaagcac

SEQ ID NO: 83602 - DNA, 20 bp, Homo sapiens
taaaaaaaaaaaaaaaaaga

SEQ ID NO: 83603 - DNA, 18 bp, Homo sapiens
aaaaaaaaaaaaaaagca

SEQ ID NO: 83604 - DNA, 21 bp, Homo sapiens
tgaaaagaaaaaaaaaacatt

SEQ ID NO: 83605 - DNA, 22 bp, Homo sapiens
aaaaaaaaaaaaaaaaaccatt

SEQ ID NO: 83606 - DNA, 22 bp, Homo sapiens
taaaatgagaagagaaaaggca

SEQ ID NO: 83607 - DNA, 19 bp, Homo sapiens
aaaaaaaaaaaaaagaaca

SEQ ID NO: 83608 - DNA, 18 bp, Homo sapiens
aaaaagaaaaaaaaaggc

SEQ ID NO: 83609 - DNA, 19 bp, Homo sapiens
aaaaaagaaaaaaaataga

SEQ ID NO: 83610 - DNA, 19 bp, Homo sapiens
aaaaaaaaaaaaaggcatt

SEQ ID NO: 83611 - DNA, 18 bp, Homo sapiens
aaaggaaaaaaaaaagca

SEQ ID NO: 83612 - DNA, 19 bp, Homo sapiens
aaaaaaaaaaaaaagaagc

SEQ ID NO: 83613 - DNA, 19 bp, Homo sapiens
aaaaaaagagaaaaaaaga

SEQ ID NO: 83614 - DNA, 20 bp, Homo sapiens
taaaaaaaaaaaaaaaaagg

SEQ ID NO: 83615 - DNA, 18 bp, Homo sapiens
aaaaagagaaaaaaaggc

SEQ ID NO: 83616 - DNA, 19 bp, Homo sapiens
taaaaaaagaaaaaaaaaa

SEQ ID NO: 83617 - DNA, 20 bp, Homo sapiens
aaaaaaaaaaaaaaagacat

SEQ ID NO: 83618 - DNA, 15 bp, Homo sapiens
taaaaaaagaaggca

SEQ ID NO: 83619 - DNA, 22 bp, Homo sapiens
aaaaaaggaaaagggaggcact

SEQ ID NO: 83620 - DNA, 19 bp, Homo sapiens
aaaaaaaaaaaaaaaaaga

SEQ ID NO: 83621 - DNA, 18 bp, Homo sapiens
agaaaaaaaaaggaccat

SEQ ID NO: 83622 - DNA, 19 bp, Homo sapiens
tgaaaaaaaaaaaaagagc

SEQ ID NO: 83623 - DNA, 19 bp, Homo sapiens
aaaaaagaaaaagaaaaac

SEQ ID NO: 83624 - DNA, 18 bp, Homo sapiens
tgaagaaaaaaaaagcac

SEQ ID NO: 83625 - DNA, 23 bp, Homo sapiens
taagaaaaggaaataaaaggcat

SEQ ID NO: 83626 - DNA, 18 bp, Homo sapiens
aaaaaaaaaaaaaaaaag

SEQ ID NO: 83627 - DNA, 24 bp, Homo sapiens
taaaaaaatttcctaaaaggcatt

SEQ ID NO: 83628 - DNA, 20 bp, Homo sapiens
aaaaagaaaaaaaaaagatt

SEQ ID NO: 83629 - DNA, 20 bp, Homo sapiens
aaaaagaaaggaaaggcatt

SEQ ID NO: 83630 - DNA, 21 bp, Homo sapiens
aaaaaaaaaaaaaaagccatt

SEQ ID NO: 83631 - DNA, 19 bp, Homo sapiens
caaaaaaagaaaaaaatgc

SEQ ID NO: 83632 - DNA, 18 bp, Homo sapiens
aaaaagagagaaaggcat

SEQ ID NO: 83633 - DNA, 19 bp, Homo sapiens
aaaaaaagaaaaagaaaag

SEQ ID NO: 83634 - DNA, 18 bp, Homo sapiens
aaaaaagaaaaaaaggca

SEQ ID NO: 83635 - DNA, 18 bp, Homo sapiens
aaaaaagaaaagaaaagg

SEQ ID NO: 83636 - DNA, 20 bp, Homo sapiens
aaaaaaaaaaaaaaaaaaca

SEQ ID NO: 83637 - DNA, 19 bp, Homo sapiens
aaaagaaaaaaaaaaaggc

SEQ ID NO: 83638 - DNA, 18 bp, Homo sapiens
aaaaaagaaaaaaaagca

SEQ ID NO: 83639 - DNA, 24 bp, Homo sapiens
caaaaggagaggaaaaaaggcatt

SEQ ID NO: 83640 - DNA, 88 bp, Amsacta moorei entomopoxvirus
ttataatttatttatctaatattaaaatatatatagtttaattaatcattaataatgtatgtattttaatatgtaatattatttataa

SEQ ID NO: 83641 - DNA, 24 bp, Amsacta moorei entomopoxvirus
taatattaaaatatatatagttta

SEQ ID NO: 83642 - DNA, 24 bp, Homo sapiens
aatattaaaatacagtgatagttt

SEQ ID NO: 83643 - DNA, 25 bp, Homo sapiens
taacattaaaataataccatagttt

SEQ ID NO: 83644 - DNA, 23 bp, Homo sapiens
taatataaaaatatacatatttt

SEQ ID NO: 83645 - DNA, 113 bp, Human herpesvirus 1
gtttgtatcgcatctttcctgtgtgtagttgtttatgttggatgcctgtgggtctatcacacccgcccctccatcccacaaacacaaaacacacgggttggatgaaaacacgc

SEQ ID NO: 83646 - DNA, 24 bp, Human herpesvirus 1
tcgcatctttcctgtgtgtagttg

SEQ ID NO: 83647 - DNA, 18 bp, Homo sapiens
tttcctcctatatagttg

SEQ ID NO: 83648 - DNA, 20 bp, Homo sapiens
gcatctttcctgatgacgtc

SEQ ID NO: 83649 - DNA, 19 bp, Homo sapiens
atctttcccactgtggttg

SEQ ID NO: 83650 - DNA, 21 bp, Homo sapiens
gcatttttttccttgtagttg

SEQ ID NO: 83651 - DNA, 107 bp, Phocoena spinipinnis papillomavirus
ggcgcctacgcactttgtatataagactgattgtaaatactaggtggagtaactaggaaaaactctaacaaaaaggtgttgtgctgtttattaaagtgtacggagcc

SEQ ID NO: 83652 - DNA, 24 bp, Phocoena spinipinnis papillomavirus
tataagactgattgtaaatactag

SEQ ID NO: 83653 - DNA, 20 bp, Homo sapiens
ctgagttttgtaaatgctag

SEQ ID NO: 83654 - DNA, 22 bp, Homo sapiens
taaagactgatctcaaaatgct

SEQ ID NO: 83655 - DNA, 17 bp, Homo sapiens
taagtatgtaaatacta

SEQ ID NO: 83656 - DNA, 23 bp, Homo sapiens
tataagtgcttaataaatactag

SEQ ID NO: 83657 - DNA, 17 bp, Homo sapiens
gactgatctaatactag

SEQ ID NO: 83658 - DNA, 76 bp, African swine fever virus
ttggataaattaggttgacattagtaacagaaagtattcaatattatgtagacctataaaaaatgagaccctccaa

SEQ ID NO: 83659 - DNA, 24 bp, African swine fever virus
ttgacattagtaacagaaagtatt

SEQ ID NO: 83660 - DNA, 23 bp, Homo sapiens
ttgacattgaaaaggaaagtatt

SEQ ID NO: 83661 - DNA, 19 bp, Homo sapiens
ttaatgttagtaacagaaa

SEQ ID NO: 83662 - DNA, 25 bp, Homo sapiens
ttgacactaatacatagaaggtatt

SEQ ID NO: 83663 - DNA, 30 bp, Homo sapiens
ttaatattagtaaagttttagaaagtatta

SEQ ID NO: 83664 - DNA, 19 bp, Homo sapiens
ttaataagacagaaagtat

SEQ ID NO: 83665 - DNA, 21 bp, Homo sapiens
ttagcaaaggcagaaagtatt

SEQ ID NO: 83666 - DNA, 114 bp, Sulfolobus virus SIRV-1
cctgtttcacctatctctaaaaatcaaaaattctatgacatttttatatctttattttttggaataagtaggattaatatttggaatttgagaaaaattatcgatagaattagg

SEQ ID NO: 83667 - DNA, 24 bp, Sulfolobus virus SIRV-1
taagtaggattaatatttggaatt

SEQ ID NO: 83668 - DNA, 21 bp, Homo sapiens
cagtctctggtatttggaatt

SEQ ID NO: 83669 - DNA, 17 bp, Homo sapiens
taagtaggattattgga

SEQ ID NO: 83670 - DNA, 21 bp, Homo sapiens
taagtagagatttatggaatt

SEQ ID NO: 83671 - DNA, 17 bp, Homo sapiens
gtaggaactttggaatt

SEQ ID NO: 83672 - DNA, 21 bp, Homo sapiens
gtagggtatcacattggaatt

SEQ ID NO: 83673 - DNA, 70 bp, Camelpox virus
tttttataaatttttatgagtatttttacaaaaatgtataaagtgtatgtcttatgtatatttataaaaa

SEQ ID NO: 83674 - DNA, 24 bp, Camelpox virus
taaagtgtatgtcttatgtatatt

SEQ ID NO: 83675 - DNA, 19 bp, Homo sapiens
aaatgtatgtaacttgtat

SEQ ID NO: 83676 - DNA, 19 bp, Homo sapiens
taaagtgtgatgtttatat

SEQ ID NO: 83677 - DNA, 19 bp, Homo sapiens
taaagtgtatatttactgt

SEQ ID NO: 83678 - DNA, 19 bp, Homo sapiens
aaagtgtatgttctggtat

SEQ ID NO: 83679 - DNA, 17 bp, Homo sapiens
caaagtgtatgttttgt

SEQ ID NO: 83680 - DNA, 21 bp, Homo sapiens
aagtattattttatgtatatt

SEQ ID NO: 83681 - DNA, 20 bp, Homo sapiens
agtgtatgttacttgtgtat

SEQ ID NO: 83682 - DNA, 21 bp, Homo sapiens
gcgtaccgatttatgtatatt

SEQ ID NO: 83683 - DNA, 17 bp, Homo sapiens
aaagttcttatgtatat

SEQ ID NO: 83684 - DNA, 21 bp, Homo sapiens
aaagtgtgtgtctaacactgt

SEQ ID NO: 83685 - DNA, 22 bp, Homo sapiens
tgaatgtatttatatgtatatt

SEQ ID NO: 83686 - DNA, 17 bp, Homo sapiens
gtgtacgtttgtatatt

SEQ ID NO: 83687 - DNA, 19 bp, Homo sapiens
taaagtgtttattgtatgt

SEQ ID NO: 83688 - DNA, 69 bp, Lymphocystis disease virus 1
cctttaaaattgatgcattataagatcgtgtagtaaatccactatcctgtaatgcattaattttaaagg

SEQ ID NO: 83689 - DNA, 24 bp, Lymphocystis disease virus 1
atgcattataagatcgtgtagtaa

SEQ ID NO: 83690 - DNA, 21 bp, Homo sapiens
atgcattatggaaaaagtagt

SEQ ID NO: 83691 - DNA, 19 bp, Homo sapiens
tgcattataggatgtttag

SEQ ID NO: 83692 - DNA, 23 bp, Homo sapiens
gcattatggttcatgtgtagtaa

SEQ ID NO: 83693 - DNA, 20 bp, Homo sapiens
tgcattttgagatcatgtag

SEQ ID NO: 83694 - DNA, 20 bp, Homo sapiens
tgcattagggcacatagtaa

SEQ ID NO: 83695 - DNA, 23 bp, Homo sapiens
atgaattatcttatgtgtagtaa

SEQ ID NO: 83696 - DNA, 22 bp, Homo sapiens
atgcattaaagacattaagtaa

SEQ ID NO: 83697 - DNA, 22 bp, Homo sapiens
atgcattaaaagatctgtctag

SEQ ID NO: 83698 - DNA, 17 bp, Homo sapiens
tgcattataagaagtag

SEQ ID NO: 83699 - DNA, 20 bp, Homo sapiens
attatgaaacaatgtagtaa

SEQ ID NO: 83700 - DNA, 22 bp, Homo sapiens
atacattataaggtcactctag

SEQ ID NO: 83701 - DNA, 21 bp, Homo sapiens
tgcattatagtgatttcagta

SEQ ID NO: 83702 - DNA, 63 bp, Lymphocystis disease virus 1
atataaatacaaaaacatatgttttagtaggaattttaggtacattagttgttgtatggatat

SEQ ID NO: 83703 - DNA, 19 bp, Lymphocystis disease virus 1
ttagttgttgtatggatat

SEQ ID NO: 83704 - DNA, 25 bp, Homo sapiens
ttagttatttgcctttgtggatata

SEQ ID NO: 83705 - DNA, 19 bp, Homo sapiens
tcagttgttccaatgatat

SEQ ID NO: 83706 - DNA, 18 bp, Homo sapiens
tagtctgaatatggatat

SEQ ID NO: 83707 - DNA, 19 bp, Homo sapiens
tagtccattgtatggatat

SEQ ID NO: 83708 - DNA, 17 bp, Homo sapiens
tcagctattgtggatat

SEQ ID NO: 83709 - DNA, 21 bp, Homo sapiens
ttagttgttgtgtgtggatat

SEQ ID NO: 83710 - DNA, 19 bp, Homo sapiens
tcagttgtacaacatggat

SEQ ID NO: 83711 - DNA, 18 bp, Homo sapiens
ctagttgcttatatggat

SEQ ID NO: 83712 - DNA, 19 bp, Homo sapiens
tagttgttacataggatat

SEQ ID NO: 83713 - DNA, 19 bp, Homo sapiens
ttattcattgtgtggatat

SEQ ID NO: 83714 - DNA, 20 bp, Homo sapiens
gtggttgtatatctggatat

SEQ ID NO: 83715 - DNA, 22 bp, Homo sapiens
ttagctgtgtgatcatggatat

SEQ ID NO: 83716 - DNA, 17 bp, Homo sapiens
tcagtgagtatggatat

SEQ ID NO: 83717 - DNA, 18 bp, Homo sapiens
ttagttgtgtgtagatat

SEQ ID NO: 83718 - DNA, 18 bp, Homo sapiens
tagttgttgtgaagacat

SEQ ID NO: 83719 - DNA, 18 bp, Homo sapiens
tcacctgtgtatggatat

SEQ ID NO: 83720 - DNA, 60 bp, Gallid herpesvirus 3
ttgtaatctgcgtcaatattctctaacttcagttaaaacgtagcaatcgcagaggggcaa

SEQ ID NO: 83721 - DNA, 24 bp, Gallid herpesvirus 3
aaaacgtagcaatcgcagaggggc

SEQ ID NO: 83722 - DNA, 17 bp, Homo sapiens
aaacgtagtagcagggg

SEQ ID NO: 83723 - DNA, 20 bp, Homo sapiens
acgtagcaacccgcatgggc

SEQ ID NO: 83724 - DNA, 16 bp, Homo sapiens
gtggcaataaaggggc

SEQ ID NO: 83725 - DNA, 19 bp, Homo sapiens
acgatagcatcagaggggc

SEQ ID NO: 83726 - DNA, 22 bp, Homo sapiens
aaaacgcagaggacagaggggc

SEQ ID NO: 83727 - DNA, 22 bp, Homo sapiens
aaaacgcagctgggggaggggc

SEQ ID NO: 83728 - DNA, 17 bp, Homo sapiens
cataggcacagaggggc

SEQ ID NO: 83729 - DNA, 19 bp, Homo sapiens
aactagagggcagaggggc

SEQ ID NO: 83730 - DNA, 17 bp, Homo sapiens
acgtggccagagagggg

SEQ ID NO: 83731 - DNA, 19 bp, Homo sapiens
gcatgctgggcagaggggc

SEQ ID NO: 83732 - DNA, 16 bp, Homo sapiens
gtgcaggcagaggggc

SEQ ID NO: 83733 - DNA, 20 bp, Homo sapiens
aaacgcagggctggaggggc

SEQ ID NO: 83734 - DNA, 22 bp, Homo sapiens
ggaacgcagcgcatggaggggc

SEQ ID NO: 83735 - DNA, 15 bp, Homo sapiens
acataggcagagggg

SEQ ID NO: 83736 - DNA, 18 bp, Homo sapiens
ggaacgaggacagagggg

SEQ ID NO: 83737 - DNA, 17 bp, Homo sapiens
aacatggctcagagggg

SEQ ID NO: 83738 - DNA, 17 bp, Homo sapiens
gtgagctgcagaggggc

SEQ ID NO: 83739 - DNA, 16 bp, Homo sapiens
gcagcatgcagagggg

SEQ ID NO: 83740 - DNA, 16 bp, Homo sapiens
aacgtagcagctgggg

SEQ ID NO: 83741 - DNA, 75 bp, Human herpesvirus 3
tctgtgggggagtggggtgttgtggatattagagggtagagggtgctggtttgaacgtctccattaacccacggg

SEQ ID NO: 83742 - DNA, 24 bp, Human herpesvirus 3
tggtttgaacgtctccattaaccc

SEQ ID NO: 83743 - DNA, 19 bp, Homo sapiens
tggtttgatcgtctccatt

SEQ ID NO: 83744 - DNA, 19 bp, Homo sapiens
tggtttgagcctccccaac

SEQ ID NO: 83745 - DNA, 18 bp, Homo sapiens
tggcttgatttattaacc

SEQ ID NO: 83746 - DNA, 15 bp, Homo sapiens
ggtttcactccatta

SEQ ID NO: 83747 - DNA, 18 bp, Homo sapiens
tggtttgaatgtgtcccc

SEQ ID NO: 83748 - DNA, 22 bp, Homo sapiens
tggtttaaatgtactataaccc

SEQ ID NO: 83749 - DNA, 22 bp, Homo sapiens
tggtttgatgttcccataaccc

SEQ ID NO: 83750 - DNA, 23 bp, Homo sapiens
tgattatcattctttattaaccc

SEQ ID NO: 83751 - DNA, 64 bp, Cherry mottle leaf virus
agcttttatgtgtgtgaagaagtgatgtttagggtaaggtctgtctttttgcattggatttgct

SEQ ID NO: 83752 - DNA, 24 bp, Cherry mottle leaf virus
tgtgtgaagaagtgatgtttaggg

SEQ ID NO: 83753 - DNA, 24 bp, Homo sapiens
tgtgtgaggcaagtactattaggg

SEQ ID NO: 83754 - DNA, 22 bp, Homo sapiens
tgtgtgaggaggagattcaagg

SEQ ID NO: 83755 - DNA, 19 bp, Homo sapiens
tgtgtgaaagggtggtggg

SEQ ID NO: 83756 - DNA, 18 bp, Homo sapiens
tgtgaggggctgtttagg

SEQ ID NO: 83757 - DNA, 23 bp, Homo sapiens
tgtgtgaaggagagtgagcaggg

SEQ ID NO: 83758 - DNA, 23 bp, Homo sapiens
tgtgtgagggggtggggcttagg

SEQ ID NO: 83759 - DNA, 22 bp, Homo sapiens
atgtgctacatgatgtttgggg

SEQ ID NO: 83760 - DNA, 21 bp, Homo sapiens
tgtttgaggaagtgggttggg

SEQ ID NO: 83761 - DNA, 21 bp, Homo sapiens
tgaaccaggtgatgtttgggg

SEQ ID NO: 83762 - DNA, 16 bp, Homo sapiens
tgttgaaggagtgaag

SEQ ID NO: 83763 - DNA, 73 bp, Little cherry virus
gagagttgaaaccttcgctactcaagttagtaagaaactactagaattcatgcacaatttggttgcaactctt

SEQ ID NO: 83764 - DNA, 24 bp, Little cherry virus
tcgctactcaagttagtaagaaac

SEQ ID NO: 83765 - DNA, 21 bp, Homo sapiens
gcttttaaggaaataagaaac

SEQ ID NO: 83766 - DNA, 18 bp, Homo sapiens
gctactcaactaggggaa

SEQ ID NO: 83767 - DNA, 16 bp, Homo sapiens
ctcaaaggtaagaaac

SEQ ID NO: 83768 - DNA, 19 bp, Homo sapiens
actcaagtctaacagaaac

SEQ ID NO: 83769 - DNA, 22 bp, Homo sapiens
gctactcagtccattaagaaac

SEQ ID NO: 83770 - DNA, 19 bp, Homo sapiens
tactgcagaatagtaagaa

SEQ ID NO: 83771 - DNA, 18 bp, Homo sapiens
gctgttcaagttagaaaa

SEQ ID NO: 83772 - DNA, 19 bp, Homo sapiens
tcctgctcaagttactaag

SEQ ID NO: 83773 - DNA, 16 bp, Homo sapiens
ctactcagcaataaaa

SEQ ID NO: 83774 - DNA, 19 bp, Homo sapiens
gctactcggaagtaagaaa

SEQ ID NO: 83775 - DNA, 19 bp, Homo sapiens
gctctttaaggtaagaaac

SEQ ID NO: 83776 - DNA, 18 bp, Homo sapiens
tactcaagaaaatagaga

SEQ ID NO: 83777 - DNA, 20 bp, Homo sapiens
gctgctgtccagtaagaaac

SEQ ID NO: 83778 - DNA, 113 bp, Lymphocystis disease virus 1
ttaaataaaagtagtaccattactttaaaagttaacgatgtttttctttttttaaaacaagttaaagatttagcatcgttaacttttaaagtattggtaccacttttatttaa

SEQ ID NO: 83779 - DNA, 24 bp, Lymphocystis disease virus 1
tagcatcgttaacttttaaagtat

SEQ ID NO: 83780 - DNA, 24 bp, Homo sapiens
tagcattttaacttctgaaagtat

SEQ ID NO: 83781 - DNA, 22 bp, Homo sapiens
tagctttcctcttttaaagtat

SEQ ID NO: 83782 - DNA, 17 bp, Homo sapiens
gcatctttcttaaagta

SEQ ID NO: 83783 - DNA, 22 bp, Homo sapiens
tagctctactgttttaaagtat

SEQ ID NO: 83784 - DNA, 22 bp, Homo sapiens
gcccaagaagcttttaaagtat

SEQ ID NO: 83785 - DNA, 90 bp, Wheat streak mosaic virus
gcgtttcgttaacccttcgttgttactaggtgtgtacttctccacgagaggcgtgcattcttggtagctatgtgtgggttagggcgacgc

SEQ ID NO: 83786 - DNA, 24 bp, Wheat streak mosaic virus
cgtgcattcttggtagctatgtgt

SEQ ID NO: 83787 - DNA, 17 bp, Homo sapiens
gtcattagagctatgtg

SEQ ID NO: 83788 - DNA, 18 bp, Homo sapiens
cggcattcttggtcagtg

SEQ ID NO: 83789 - DNA, 21 bp, Homo sapiens
gtgttgtttccctctatgtgt

SEQ ID NO: 83790 - DNA, 19 bp, Homo sapiens
cgtgtgttctggtgggcca

SEQ ID NO: 83791 - DNA, 121 bp, Human herpesvirus 8
tggcagttgacgggtttgtgatagctggagtgctgaccacggcacaggacccattaactttcctatgtgtttatttttagcaatggtctccagaattcaaggatctcaaaagggcctgcca

SEQ ID NO: 83792 - DNA, 24 bp, Human herpesvirus 8
agctggagtgctgaccacggcaca

SEQ ID NO: 83793 - DNA, 18 bp, Homo sapiens
gctggagtgcagcggtac

SEQ ID NO: 83794 - DNA, 18 bp, Homo sapiens
gctggagtgcaacggcac

SEQ ID NO: 83795 - DNA, 19 bp, Homo sapiens
actggagtgcagtggcgca

SEQ ID NO: 83796 - DNA, 16 bp, Homo sapiens
gctggagtgcgatggc

SEQ ID NO: 83797 - DNA, 18 bp, Homo sapiens
gctggagtgtaatggcac

SEQ ID NO: 83798 - DNA, 17 bp, Homo sapiens
agcggaacgccacggcc

SEQ ID NO: 83799 - DNA, 21 bp, Homo sapiens
agctggaggcttcaaatggca

SEQ ID NO: 83800 - DNA, 24 bp, Homo sapiens
agctggggttgttggccaggggca

SEQ ID NO: 83801 - DNA, 18 bp, Homo sapiens
gctggagtgcagtggcac

SEQ ID NO: 83802 - DNA, 18 bp, Homo sapiens
gctggagtgcagcggcac

SEQ ID NO: 83803 - DNA, 18 bp, Homo sapiens
actggagtgctgacgcac

SEQ ID NO: 83804 - DNA, 18 bp, Homo sapiens
gctggagtgcaatggcac

SEQ ID NO: 83805 - DNA, 18 bp, Homo sapiens
gctggagtgtgaccgccg

SEQ ID NO: 83806 - DNA, 18 bp, Homo sapiens
gccggagtgcactggcac

SEQ ID NO: 83807 - DNA, 18 bp, Homo sapiens
agctggagtgcagtagca

SEQ ID NO: 83808 - DNA, 18 bp, Homo sapiens
gctggagtgcagtagcac

SEQ ID NO: 83809 - DNA, 16 bp, Homo sapiens
gctggagtgtgatggc

SEQ ID NO: 83810 - DNA, 19 bp, Homo sapiens
actggagtgctgaccagca

SEQ ID NO: 83811 - DNA, 24 bp, Homo sapiens
gcaggagtgctggcttggaccaca

SEQ ID NO: 83812 - DNA, 20 bp, Homo sapiens
agctggaatgctggggtgca

SEQ ID NO: 83813 - DNA, 17 bp, Homo sapiens
ctggagtgcactggcac

SEQ ID NO: 83814 - DNA, 20 bp, Homo sapiens
agctggaatgttgggccaca

SEQ ID NO: 83815 - DNA, 18 bp, Homo sapiens
actggagtgcagtggcac

SEQ ID NO: 83816 - DNA, 17 bp, Homo sapiens
gctggagtgccgtggcc

SEQ ID NO: 83817 - DNA, 22 bp, Homo sapiens
actggagtgttggtcatgcagc

SEQ ID NO: 83818 - DNA, 19 bp, Homo sapiens
agctggagtgcagtggtac

SEQ ID NO: 83819 - DNA, 16 bp, Homo sapiens
gctggagtgcgacagg

SEQ ID NO: 83820 - DNA, 16 bp, Homo sapiens
agttggaggctgggca

SEQ ID NO: 83821 - DNA, 21 bp, Homo sapiens
agctggcgcctccacggcaca

SEQ ID NO: 83822 - DNA, 17 bp, Homo sapiens
gctggagtgcagcggca

SEQ ID NO: 83823 - DNA, 17 bp, Homo sapiens
agctggagtctgaaagc

SEQ ID NO: 83824 - DNA, 17 bp, Homo sapiens
actggagtggagtggca

SEQ ID NO: 83825 - DNA, 16 bp, Homo sapiens
gctggggtgacggcac

SEQ ID NO: 83826 - DNA, 16 bp, Homo sapiens
gctggagtgctatggc

SEQ ID NO: 83827 - DNA, 18 bp, Homo sapiens
agctggagcgctggacca

SEQ ID NO: 83828 - DNA, 18 bp, Homo sapiens
gctggagcgcaatggcac

SEQ ID NO: 83829 - DNA, 18 bp, Homo sapiens
agctagagtgggatggca

SEQ ID NO: 83830 - DNA, 18 bp, Homo sapiens
gctgaagtgcagtggcac

SEQ ID NO: 83831 - DNA, 20 bp, Homo sapiens
agctggaggttggccaggca

SEQ ID NO: 83832 - DNA, 19 bp, Homo sapiens
gctggagtgcagtcgtgca

SEQ ID NO: 83833 - DNA, 18 bp, Homo sapiens
aactgggagccacggcac

SEQ ID NO: 83834 - DNA, 18 bp, Homo sapiens
gctggagtggaatggcac

SEQ ID NO: 83835 - DNA, 19 bp, Homo sapiens
gctggagtgccgtggtgca

SEQ ID NO: 83836 - DNA, 18 bp, Homo sapiens
gctggagtgccgtggcac

SEQ ID NO: 83837 - DNA, 17 bp, Homo sapiens
gctggagtgcagcggcc

SEQ ID NO: 83838 - DNA, 18 bp, Homo sapiens
gctggagcgcagtggcac

SEQ ID NO: 83839 - DNA, 19 bp, Homo sapiens
agctggagtgcagtggcac

SEQ ID NO: 83840 - DNA, 18 bp, Homo sapiens
agctggaatgcagtggcc

SEQ ID NO: 83841 - DNA, 18 bp, Homo sapiens
agctggaggcggtggcac

SEQ ID NO: 83842 - DNA, 19 bp, Homo sapiens
agcggagtgctggagtgca

SEQ ID NO: 83843 - DNA, 15 bp, Homo sapiens
gctggagtgcccggc

SEQ ID NO: 83844 - DNA, 18 bp, Homo sapiens
gctagagtgcagtggcac

SEQ ID NO: 83845 - DNA, 19 bp, Homo sapiens
agctggaggctcccaggca

SEQ ID NO: 83846 - DNA, 18 bp, Homo sapiens
gctggagtgccatggtac

SEQ ID NO: 83847 - DNA, 18 bp, Homo sapiens
actggagtgcaatggcac

SEQ ID NO: 83848 - DNA, 18 bp, Homo sapiens
gctggagtgcagcagcac

SEQ ID NO: 83849 - DNA, 18 bp, Homo sapiens
gctggaatgcagtggcac

SEQ ID NO: 83850 - DNA, 17 bp, Homo sapiens
gctggagtgtaatggca

SEQ ID NO: 83851 - DNA, 19 bp, Homo sapiens
gctggagtctggcccctgc

SEQ ID NO: 83852 - DNA, 18 bp, Homo sapiens
agcaggcggccacggcac

SEQ ID NO: 83853 - DNA, 17 bp, Homo sapiens
gctggagtgcagcagca

SEQ ID NO: 83854 - DNA, 19 bp, Homo sapiens
gcgtgggtgggccacggca

SEQ ID NO: 83855 - DNA, 18 bp, Homo sapiens
gctgagcttctgtggcac

SEQ ID NO: 83856 - DNA, 19 bp, Homo sapiens
aactggagtgcagtggtac

SEQ ID NO: 83857 - DNA, 19 bp, Homo sapiens
agctgggtgctggccaggg

SEQ ID NO: 83858 - DNA, 16 bp, Homo sapiens
gctggagtgcaacggc

SEQ ID NO: 83859 - DNA, 17 bp, Homo sapiens
agctgggcgtggtggcc

SEQ ID NO: 83860 - DNA, 16 bp, Homo sapiens
gctggagtgccgtggc

SEQ ID NO: 83861 - DNA, 18 bp, Homo sapiens
agctggagtgcaatggcc

SEQ ID NO: 83862 - DNA, 18 bp, Homo sapiens
gccggagtgcaatggcac

SEQ ID NO: 83863 - DNA, 20 bp, Homo sapiens
agctggaggctggccaggca

SEQ ID NO: 83864 - DNA, 16 bp, Homo sapiens
gctggagtgtaatggc

SEQ ID NO: 83865 - DNA, 18 bp, Homo sapiens
gctggagtgtggtggcac

SEQ ID NO: 83866 - DNA, 17 bp, Homo sapiens
gctggagtgtggtggcc

SEQ ID NO: 83867 - DNA, 15 bp, Homo sapiens
gcggagtgctgggca

SEQ ID NO: 83868 - DNA, 19 bp, Homo sapiens
agttggaggctggaccgca

SEQ ID NO: 83869 - DNA, 18 bp, Homo sapiens
agctggagtgcaatggca

SEQ ID NO: 83870 - DNA, 17 bp, Homo sapiens
agttggagcgccacggc

SEQ ID NO: 83871 - DNA, 20 bp, Homo sapiens
agctgggggctgaccagaca

SEQ ID NO: 83872 - DNA, 18 bp, Homo sapiens
agctggagtgcagtggca

SEQ ID NO: 83873 - DNA, 20 bp, Homo sapiens
agctggagtgtctggcttgc

SEQ ID NO: 83874 - DNA, 19 bp, Homo sapiens
gctgagtgctgggcccaca

SEQ ID NO: 83875 - DNA, 19 bp, Homo sapiens
agctgagtgctgagttgca

SEQ ID NO: 83876 - DNA, 18 bp, Homo sapiens
gctggagtggagtggcac

SEQ ID NO: 83877 - DNA, 19 bp, Homo sapiens
agctgaagtgcagtggcac

SEQ ID NO: 83878 - DNA, 23 bp, Homo sapiens
gctggagtgcgtgcagtggcaca

SEQ ID NO: 83879 - DNA, 17 bp, Homo sapiens
gctggaatgcactggca

SEQ ID NO: 83880 - DNA, 17 bp, Homo sapiens
gctggagtgcactggca

SEQ ID NO: 83881 - DNA, 20 bp, Homo sapiens
gctggagtgagtgccatggc

SEQ ID NO: 83882 - DNA, 21 bp, Homo sapiens
agttggagtgctgtgtccaca

SEQ ID NO: 83883 - DNA, 22 bp, Homo sapiens
agctggagctgcttgtggtgca

SEQ ID NO: 83884 - DNA, 17 bp, Homo sapiens
gctggagtgctgtagca

SEQ ID NO: 83885 - DNA, 18 bp, Homo sapiens
gctggagtgcactggcac

SEQ ID NO: 83886 - DNA, 18 bp, Homo sapiens
gctagagtgcaatggcac

SEQ ID NO: 83887 - DNA, 17 bp, Homo sapiens
aactggagttctgtggc

SEQ ID NO: 83888 - DNA, 17 bp, Homo sapiens
gctggaatgctgtggcc

SEQ ID NO: 83889 - DNA, 17 bp, Homo sapiens
gctggagtgatgtggca

SEQ ID NO: 83890 - DNA, 18 bp, Homo sapiens
agctggagtgcactggcc

SEQ ID NO: 83891 - DNA, 16 bp, Homo sapiens
gctggagtgctgtggc

SEQ ID NO: 83892 - DNA, 17 bp, Homo sapiens
gctagagtggagtggcc

SEQ ID NO: 83893 - DNA, 15 bp, Homo sapiens
ggatgccacggcaca

SEQ ID NO: 83894 - DNA, 19 bp, Homo sapiens
gctggagtgcgacagtgca

SEQ ID NO: 83895 - DNA, 64 bp, Amsacta moorei entomopoxvirus
attaattattttataattttataatttatgaaaaataaaatatattttattaaaaataattaat

SEQ ID NO: 83896 - DNA, 24 bp, Amsacta moorei entomopoxvirus
tttataattttataatttatgaaa

SEQ ID NO: 83897 - DNA, 23 bp, Homo sapiens
tttaaaattttataatttatcaa

SEQ ID NO: 83898 - DNA, 103 bp, Beet soil-borne mosaic virus
attgtctgatatcttgtcctgggggcaattttattcagtgccctaactttggaaatacgtgcgagtaataagtagcccccgtccaggagaagttgcttacaat

SEQ ID NO: 83899 - DNA, 24 bp, Beet soil-borne mosaic virus
taagtagcccccgtccaggagaag

SEQ ID NO: 83900 - DNA, 20 bp, Homo sapiens
gtagcctagcagaggagaag

SEQ ID NO: 83901 - DNA, 23 bp, Homo sapiens
cactcagccctgtctaggagaag

SEQ ID NO: 83902 - DNA, 15 bp, Homo sapiens
gcagccctccaggag

SEQ ID NO: 83903 - DNA, 22 bp, Homo sapiens
caagtagctctgagaggggaag

SEQ ID NO: 83904 - DNA, 18 bp, Homo sapiens
taactggcccaaggagaa

SEQ ID NO: 83905 - DNA, 19 bp, Homo sapiens
agccagcccccaggaggag

SEQ ID NO: 83906 - DNA, 21 bp, Homo sapiens
aagtggcctgccaccaggaga

SEQ ID NO: 83907 - DNA, 24 bp, Homo sapiens
taaatagtctcataagaggagaag

SEQ ID NO: 83908 - DNA, 20 bp, Homo sapiens
gcccgccccgtccaggggga

SEQ ID NO: 83909 - DNA, 25 bp, Homo sapiens
gtggcctccgtgttcctgggggaag

SEQ ID NO: 83910 - DNA, 23 bp, Homo sapiens
gcagttttgccatgcaggagaag

SEQ ID NO: 83911 - DNA, 18 bp, Homo sapiens
gtggccgagtaggagaag

SEQ ID NO: 83912 - DNA, 20 bp, Homo sapiens
aagtagccttctgggggaag

SEQ ID NO: 83913 - DNA, 19 bp, Homo sapiens
tagtccatgtccaggagaa

SEQ ID NO: 83914 - DNA, 20 bp, Homo sapiens
agtagttaagttaggagaag

SEQ ID NO: 83915 - DNA, 21 bp, Homo sapiens
taagtagcctttgcaaaggaa

SEQ ID NO: 83916 - DNA, 17 bp, Homo sapiens
aggggcccccatgggaa

SEQ ID NO: 83917 - DNA, 18 bp, Homo sapiens
agagtccaggccaggaga

SEQ ID NO: 83918 - DNA, 16 bp, Homo sapiens
gcagcaccaggagaag

SEQ ID NO: 83919 - DNA, 16 bp, Homo sapiens
gtagcccccgcagaag

SEQ ID NO: 83920 - DNA, 20 bp, Homo sapiens
gttgccccatccaggagaag

SEQ ID NO: 83921 - DNA, 17 bp, Homo sapiens
aagtggcccccaggaga

SEQ ID NO: 83922 - DNA, 19 bp, Homo sapiens
agcagttcctgaggagaag

SEQ ID NO: 83923 - DNA, 21 bp, Homo sapiens
gtagcccctgtctaggttaag

SEQ ID NO: 83924 - DNA, 84 bp, Paramecium bursaria Chlorella virus 1
tgcatttgttgcatttcctgttcatcacgatatacaacatcacaaaaagtatagcaacggacacggcaatagtgactttatgca

SEQ ID NO: 83925 - DNA, 24 bp, Paramecium bursaria Chlorella virus 1
tagcaacggacacggcaatagtga

SEQ ID NO: 83926 - DNA, 19 bp, Homo sapiens
gcaggggacacagccagtg

SEQ ID NO: 83927 - DNA, 17 bp, Homo sapiens
gcatggacacgacagtg

SEQ ID NO: 83928 - DNA, 17 bp, Homo sapiens
acaacggacacacggtg

SEQ ID NO: 83929 - DNA, 19 bp, Homo sapiens
acaacggatatgcaacgtg

SEQ ID NO: 83930 - DNA, 21 bp, Homo sapiens
tagcggtagaagaaatagtga

SEQ ID NO: 83931 - DNA, 16 bp, Homo sapiens
gcagcggacacggagt

SEQ ID NO: 83932 - DNA, 106 bp, Rice yellow stunt virus
ttgtgtccatatgtgtacccgagaaagtaatttaatgttgtagaacctaagagctattaataaaaacccaatacctcaacattctcaacagaaaaccacggcacag

SEQ ID NO: 83933 - DNA, 24 bp, Rice yellow stunt virus
tacctcaacattctcaacagaaaa

SEQ ID NO: 83934 - DNA, 21 bp, Homo sapiens
ccttggctgcccaacagaaaa

SEQ ID NO: 83935 - DNA, 19 bp, Homo sapiens
cctcaaaatcctcaacaga

SEQ ID NO: 83936 - DNA, 17 bp, Homo sapiens
acctcaacagcagcaga

SEQ ID NO: 83937 - DNA, 21 bp, Homo sapiens
cccaggattttcaacagaaaa

SEQ ID NO: 83938 - DNA, 16 bp, Homo sapiens
cacttcaacatcagaa

SEQ ID NO: 83939 - DNA, 20 bp, Homo sapiens
tacctgactctcaatagaaa

SEQ ID NO: 83940 - DNA, 21 bp, Homo sapiens
cacctcaagggaataacagaa

SEQ ID NO: 83941 - DNA, 19 bp, Homo sapiens
tacctcagcactctcacag

SEQ ID NO: 83942 - DNA, 19 bp, Homo sapiens
tcaacatccatctagcaga

SEQ ID NO: 83943 - DNA, 19 bp, Homo sapiens
ctcactcattgacagaaaa

SEQ ID NO: 83944 - DNA, 18 bp, Homo sapiens
ctcaacattccaagggaa

SEQ ID NO: 83945 - DNA, 18 bp, Homo sapiens
cctctcatttaacagaaa

SEQ ID NO: 83946 - DNA, 18 bp, Homo sapiens
cctcaacatatcactcag

SEQ ID NO: 83947 - DNA, 21 bp, Homo sapiens
acctcaacattagacaataga

SEQ ID NO: 83948 - DNA, 20 bp, Homo sapiens
ccttttctttcaacagaaaa

SEQ ID NO: 83949 - DNA, 20 bp, Homo sapiens
cctcagctacaaacagaaaa

SEQ ID NO: 83950 - DNA, 21 bp, Homo sapiens
ctcagctcctagtaacagaaa

SEQ ID NO: 83951 - DNA, 21 bp, Homo sapiens
tcaacattttatatcagaaaa

SEQ ID NO: 83952 - DNA, 20 bp, Homo sapiens
cctcaacactcagtaacaga

SEQ ID NO: 83953 - DNA, 23 bp, Homo sapiens
tacctcaatataatcatagaaaa

SEQ ID NO: 83954 - DNA, 20 bp, Homo sapiens
ctcgatgtcatcaacagaaa

SEQ ID NO: 83955 - DNA, 23 bp, Homo sapiens
tacctcaatatatgttatagaaa

SEQ ID NO: 83956 - DNA, 23 bp, Homo sapiens
tacttcaacatttttgttctcaa

SEQ ID NO: 83957 - DNA, 25 bp, Homo sapiens
tactctcaagacatctttcagcaga

SEQ ID NO: 83958 - DNA, 20 bp, Homo sapiens
taccgtaattcaaacagaaa

SEQ ID NO: 83959 - DNA, 24 bp, Homo sapiens
tacctcaaaggagataacagaaaa

SEQ ID NO: 83960 - DNA, 17 bp, Homo sapiens
ctcaacttccaacagaa

SEQ ID NO: 83961 - DNA, 20 bp, Homo sapiens
ctaacattctcctatgcaaa

SEQ ID NO: 83962 - DNA, 17 bp, Homo sapiens
tctgcatctcaacagaa

SEQ ID NO: 83963 - DNA, 21 bp, Homo sapiens
ctcaacattcatatgacagaa

SEQ ID NO: 83964 - DNA, 21 bp, Homo sapiens
ctcaacaaaacaaaacagaaa

SEQ ID NO: 83965 - DNA, 22 bp, Homo sapiens
taccttgaaatctgacagaaaa

SEQ ID NO: 83966 - DNA, 18 bp, Homo sapiens
tcagcatccctcagaaaa

SEQ ID NO: 83967 - DNA, 22 bp, Homo sapiens
acctcaatggatgtaacagaaa

SEQ ID NO: 83968 - DNA, 19 bp, Homo sapiens
tacctcaaaatgcttcaga

SEQ ID NO: 83969 - DNA, 20 bp, Homo sapiens
ccttactgtaccaacagaaa

SEQ ID NO: 83970 - DNA, 20 bp, Homo sapiens
tcagcatttcagacagaaaa

SEQ ID NO: 83971 - DNA, 20 bp, Homo sapiens
tacccaacagaatcagacag

SEQ ID NO: 83972 - DNA, 19 bp, Homo sapiens
tcaacattttcagccaaaa

SEQ ID NO: 83973 - DNA, 85 bp, Lymphocystis disease virus 1
tacatttctaaatataaattaaatttgttatgatctgataagcgagtatcttgatcaaattgtcgtgctaaaatttttaaacgta

SEQ ID NO: 83974 - DNA, 24 bp, Lymphocystis disease virus 1
catttctaaatataaattaaattt

SEQ ID NO: 83975 - DNA, 20 bp, Homo sapiens
catttctaaagttataaatt

SEQ ID NO: 83976 - DNA, 18 bp, Homo sapiens
catttcaaatataaatca

SEQ ID NO: 83977 - DNA, 18 bp, Homo sapiens
catttctaaacatatatt

SEQ ID NO: 83978 - DNA, 69 bp, Human herpesvirus 1
cgtgtttattcaagggagtgggatagggttcgacggttcgaaacttaacacaccaaataatcgagcgcg

SEQ ID NO: 83979 - DNA, 24 bp, Human herpesvirus 1
agggagtgggatagggttcgacgg

SEQ ID NO: 83980 - DNA, 25 bp, Homo sapiens
agggagtggggctggagggcgatgg

SEQ ID NO: 83981 - DNA, 24 bp, Homo sapiens
agggagtgggaaaagagatgatgg

SEQ ID NO: 83982 - DNA, 21 bp, Homo sapiens
agagagtggggtgcccgatgg

SEQ ID NO: 83983 - DNA, 17 bp, Homo sapiens
agggagtggggtgagct

SEQ ID NO: 83984 - DNA, 19 bp, Homo sapiens
agggggtgggggagctcaa

SEQ ID NO: 83985 - DNA, 19 bp, Homo sapiens
agggggtggggtagggtcg

SEQ ID NO: 83986 - DNA, 22 bp, Homo sapiens
agggagtgtgggtgatgagggt

SEQ ID NO: 83987 - DNA, 23 bp, Homo sapiens
agggagtggggtgggaggggtgg

SEQ ID NO: 83988 - DNA, 18 bp, Homo sapiens
gggagtggggagggggcg

SEQ ID NO: 83989 - DNA, 22 bp, Homo sapiens
gggaatggggtaggagggatgg

SEQ ID NO: 83990 - DNA, 22 bp, Homo sapiens
agggggtgggagggtagagtgg

SEQ ID NO: 83991 - DNA, 19 bp, Homo sapiens
gggagtgggatgggtgtcg

SEQ ID NO: 83992 - DNA, 17 bp, Homo sapiens
gggagtgggatgggtcg

SEQ ID NO: 83993 - DNA, 20 bp, Homo sapiens
aggagtgggatggcagtagg

SEQ ID NO: 83994 - DNA, 17 bp, Homo sapiens
gggagtgggaggggacg

SEQ ID NO: 83995 - DNA, 26 bp, Homo sapiens
agggggtggggcgggggcgagaacgg

SEQ ID NO: 83996 - DNA, 24 bp, Homo sapiens
agggggtgggaggagggtcggtgg

SEQ ID NO: 83997 - DNA, 20 bp, Homo sapiens
gggagtggagtggaggtgcg

SEQ ID NO: 83998 - DNA, 21 bp, Homo sapiens
agggagtgggaaggaggaagg

SEQ ID NO: 83999 - DNA, 19 bp, Homo sapiens
gggagtgggctggaaccaa

SEQ ID NO: 84000 - DNA, 19 bp, Homo sapiens
agagggtggggtagggtcc

SEQ ID NO: 84001 - DNA, 20 bp, Homo sapiens
ggggtggctgtgttcgacgg

SEQ ID NO: 84002 - DNA, 22 bp, Homo sapiens
gggagtggggatggggtgacag

SEQ ID NO: 84003 - DNA, 22 bp, Homo sapiens
gggagtggggcaatcgaggcgg

SEQ ID NO: 84004 - DNA, 20 bp, Homo sapiens
agggagtggggagggtctaa

SEQ ID NO: 84005 - DNA, 19 bp, Homo sapiens
aggggctgggataggagtt

SEQ ID NO: 84006 - DNA, 18 bp, Homo sapiens
aggcagtgggatggggtt

SEQ ID NO: 84007 - DNA, 16 bp, Homo sapiens
gggagtgggaggggag

SEQ ID NO: 84008 - DNA, 110 bp, Bovine herpesvirus 1
cccccctcaccggtgttaatacgcacgacaataaatgagctgacacacgctcgcacatacacagtttgtttgccgtttatttgtttattggggacagcgacggggcgggg

SEQ ID NO: 84009 - DNA, 24 bp, Bovine herpesvirus 1
tttgccgtttatttgtttattggg

SEQ ID NO: 84010 - DNA, 16 bp, Homo sapiens
tttgccttttatattg

SEQ ID NO: 84011 - DNA, 90 bp, Paramecium bursaria Chlorella virus 1
tttttaaaaatttgaatttatgttcgtcatttgacccaggtaagataaatgacaaagtaaggtaatataaatttaaggtcaatctaaaaa

SEQ ID NO: 84012 - DNA, 24 bp, Paramecium bursaria Chlorella virus 1
tgacaaagtaaggtaatataaatt

SEQ ID NO: 84013 - DNA, 19 bp, Homo sapiens
tgacaaaatgagatactat

SEQ ID NO: 84014 - DNA, 20 bp, Homo sapiens
aaaatacagtaatataaatt

SEQ ID NO: 84015 - DNA, 18 bp, Homo sapiens
tgacaaagataaggtaac

SEQ ID NO: 84016 - DNA, 20 bp, Homo sapiens
acaaagaaagaatataaatt

SEQ ID NO: 84017 - DNA, 20 bp, Homo sapiens
gacaaggtggcatataaatt

SEQ ID NO: 84018 - DNA, 20 bp, Homo sapiens
acaaagtgatatcataaatt

SEQ ID NO: 84019 - DNA, 93 bp, Human herpesvirus 5
ggctccgaaggtccgctgctcggctccgctcaccgctccggtctggctgcagcagtgcttcgctgagaagtagcgtgtggactgaacggtgtt

SEQ ID NO: 84020 - DNA, 24 bp, Human herpesvirus 5
tgagaagtagcgtgtggactgaac

SEQ ID NO: 84021 - DNA, 20 bp, Homo sapiens
tgagaagtgacgccgttctg

SEQ ID NO: 84022 - DNA, 18 bp, Homo sapiens
tgagaagagaggctggac

SEQ ID NO: 84023 - DNA, 16 bp, Homo sapiens
gaggaccgtggactga

SEQ ID NO: 84024 - DNA, 19 bp, Homo sapiens
tgagcagtgcaggactgaa

SEQ ID NO: 84025 - DNA, 18 bp, Homo sapiens
gagaagtggtttgcactg

SEQ ID NO: 84026 - DNA, 23 bp, Homo sapiens
tgagaggtacgtgtaagggactg

SEQ ID NO: 84027 - DNA, 18 bp, Homo sapiens
gagatggtgtggactgaa

SEQ ID NO: 84028 - DNA, 19 bp, Homo sapiens
tgggaagggtgcggacaga

SEQ ID NO: 84029 - DNA, 21 bp, Homo sapiens
tgagaaggagagggactgaac

SEQ ID NO: 84030 - DNA, 18 bp, Homo sapiens
tgagaaatggttaggctg

SEQ ID NO: 84031 - DNA, 20 bp, Homo sapiens
tgagaagtggtcgtgaggac

SEQ ID NO: 84032 - DNA, 15 bp, Homo sapiens
gaaaatgtggactga

SEQ ID NO: 84033 - DNA, 17 bp, Homo sapiens
tgaggtcttgtggactg

SEQ ID NO: 84034 - DNA, 19 bp, Homo sapiens
tgggaagcagcggcctgga

SEQ ID NO: 84035 - DNA, 17 bp, Homo sapiens
gagtagtgtggacagga

SEQ ID NO: 84036 - DNA, 21 bp, Homo sapiens
gagaggtggcacaaactgaac

SEQ ID NO: 84037 - DNA, 18 bp, Homo sapiens
gaggagtaaactggactg

SEQ ID NO: 84038 - DNA, 20 bp, Homo sapiens
tgagggtagcgtccctggac

SEQ ID NO: 84039 - DNA, 20 bp, Homo sapiens
tgagaagcagtgttgtgtga

SEQ ID NO: 84040 - DNA, 23 bp, Homo sapiens
tggaggtggcgcggggactgaac

SEQ ID NO: 84041 - DNA, 19 bp, Homo sapiens
gaagcgtatgtgggttgaa

SEQ ID NO: 84042 - DNA, 21 bp, Homo sapiens
tgagcagtggctccaaactga

SEQ ID NO: 84043 - DNA, 20 bp, Homo sapiens
tgatgagtcagtggactgaa

SEQ ID NO: 84044 - DNA, 17 bp, Homo sapiens
tgggaagtagctgtgga

SEQ ID NO: 84045 - DNA, 18 bp, Homo sapiens
tgagaagtggtgttgtga

SEQ ID NO: 84046 - DNA, 88 bp, Sida golden mosaic virus
tctgtctgtcgcgaaacgtacagctctaattacattgtttaaggagataatgcctaattgatctaagtacatgttgaccaaacgcaga

SEQ ID NO: 84047 - DNA, 24 bp, Sida golden mosaic virus
ataatgcctaattgatctaagtac

SEQ ID NO: 84048 - DNA, 18 bp, Homo sapiens
ataatgcccatcctaggt

SEQ ID NO: 84049 - DNA, 21 bp, Homo sapiens
taatgcctgcattttcagtac

SEQ ID NO: 84050 - DNA, 18 bp, Homo sapiens
tgcctattttatccaagt

SEQ ID NO: 84051 - DNA, 19 bp, Homo sapiens
atgctggatgaccaagtac

SEQ ID NO: 84052 - DNA, 18 bp, Homo sapiens
caatgcctggatttaagt

SEQ ID NO: 84053 - DNA, 66 bp, Ryegrass mottle virus
cttcgagaaaagcgctcttcgagtactccctcggcagactattctgttgcgtctcccatagtgaag

SEQ ID NO: 84054 - DNA, 22 bp, Ryegrass mottle virus
tgttgcgtctcccatagtgaag

SEQ ID NO: 84055 - DNA, 18 bp, Homo sapiens
tgttgcgtcttcctgcga

SEQ ID NO: 84056 - DNA, 19 bp, Homo sapiens
tggtgtgtctcccatactg

SEQ ID NO: 84057 - DNA, 19 bp, Homo sapiens
tgttgctcttcctctgaag

SEQ ID NO: 84058 - DNA, 16 bp, Homo sapiens
tgttgcgtcctcagaa

SEQ ID NO: 84059 - DNA, 20 bp, Homo sapiens
tgttgcgctccgtcaggaag

SEQ ID NO: 84060 - DNA, 20 bp, Homo sapiens
tgcaccctctcatggtgaag

SEQ ID NO: 84061 - DNA, 18 bp, Homo sapiens
tgttgcgtttcttcatag

SEQ ID NO: 84062 - DNA, 18 bp, Homo sapiens
tgttgggtctcccacctg

SEQ ID NO: 84063 - DNA, 19 bp, Homo sapiens
gtctgccactgtagtgaag

SEQ ID NO: 84064 - DNA, 19 bp, Homo sapiens
tgagtctttcatagtgaag

SEQ ID NO: 84065 - DNA, 67 bp, Fowl adenovirus D
cgggttgacaaaatcgaacggtgtttaagctttgaccggtgagctccgcgaagactctgtaagcctg

SEQ ID NO: 84066 - DNA, 24 bp, Fowl adenovirus D
tgagctccgcgaagactctgtaag

SEQ ID NO: 84067 - DNA, 21 bp, Homo sapiens
tgagctccgtaagtttgtaag

SEQ ID NO: 84068 - DNA, 17 bp, Homo sapiens
tggcttcaagactctgt

SEQ ID NO: 84069 - DNA, 17 bp, Homo sapiens
tgaggtccgcgaagtgc

SEQ ID NO: 84070 - DNA, 18 bp, Homo sapiens
gagttccgcgaaggctgc

SEQ ID NO: 84071 - DNA, 18 bp, Homo sapiens
ctctcaaggctctgtaag

SEQ ID NO: 84072 - DNA, 17 bp, Homo sapiens
tgagctcctgaagtcta

SEQ ID NO: 84073 - DNA, 23 bp, Homo sapiens
tgggccccgcggaggaagttaag

SEQ ID NO: 84074 - DNA, 16 bp, Homo sapiens
aagctagactctgtaa

SEQ ID NO: 84075 - DNA, 18 bp, Homo sapiens
gagctccgcggaggctcc

SEQ ID NO: 84076 - DNA, 23 bp, Homo sapiens
tgagctccgtgaagcagctgaag

SEQ ID NO: 84077 - DNA, 19 bp, Homo sapiens
tgagacgggactctgtaag

SEQ ID NO: 84078 - DNA, 22 bp, Homo sapiens
tgagcttctaattttctgtaag

SEQ ID NO: 84079 - DNA, 20 bp, Homo sapiens
tgagctcctggaggtgactc

SEQ ID NO: 84080 - DNA, 21 bp, Homo sapiens
agctccgcggaggaccagctg

SEQ ID NO: 84081 - DNA, 131 bp, Human herpesvirus 5
cgtgagaggctgacagcttacgaagcaaaatcacaaagaaaatacacatgcagcacctagatatccagtttaaccccgtatatcacaagtctctgtgtcaatattttttgtctagtttttttttcctcctg

SEQ ID NO: 84082 - DNA, 24 bp, Human herpesvirus 5
accccgtatatcacaagtctctgt

SEQ ID NO: 84083 - DNA, 19 bp, Homo sapiens
atatatcacagttctttgt

SEQ ID NO: 84084 - DNA, 19 bp, Homo sapiens
ccttgtccaaggtctctgt

SEQ ID NO: 84085 - DNA, 23 bp, Homo sapiens
cctcgtatgtccaaagtctctgt

SEQ ID NO: 84086 - DNA, 24 bp, Homo sapiens
ccccagagcatcacaagtctttgt

SEQ ID NO: 84087 - DNA, 23 bp, Homo sapiens
cccacgatggtgcaggtctctgt

SEQ ID NO: 84088 - DNA, 21 bp, Homo sapiens
catccatctacaggtctctgt

SEQ ID NO: 84089 - DNA, 19 bp, Homo sapiens
cattctcacaagtttctgt

SEQ ID NO: 84090 - DNA, 20 bp, Homo sapiens
acctgggcatgggtctctgt

SEQ ID NO: 84091 - DNA, 18 bp, Homo sapiens
gtagtcttaagtctctgt

SEQ ID NO: 84092 - DNA, 21 bp, Homo sapiens
cccaaccccatgagtctctgt

SEQ ID NO: 84093 - DNA, 20 bp, Homo sapiens
ccgtgtctccccacctctgt

SEQ ID NO: 84094 - DNA, 21 bp, Homo sapiens
acccctgtatttatcttctgt

SEQ ID NO: 84095 - DNA, 22 bp, Homo sapiens
ccctgtgtacatgtgtctctgt

SEQ ID NO: 84096 - DNA, 22 bp, Homo sapiens
cctggtattcataagtctctgt

SEQ ID NO: 84097 - DNA, 19 bp, Homo sapiens
cctgtgtattgacaagtct

SEQ ID NO: 84098 - DNA, 18 bp, Homo sapiens
catatatcaggcttctgt

SEQ ID NO: 84099 - DNA, 80 bp, Human herpesvirus 5
cccggacagcgtgcaagtctcgactaaggagcgggcgcgagcgagcgaaagttttatagagagcacacacgacgaccggg

SEQ ID NO: 84100 - DNA, 24 bp, Human herpesvirus 5
tagagagcacacacgacgaccggg

SEQ ID NO: 84101 - DNA, 19 bp, Homo sapiens
gagagaactcccgaccggg

SEQ ID NO: 84102 - DNA, 26 bp, Homo sapiens
cagagagcacacatgaaatcactggg

SEQ ID NO: 84103 - DNA, 19 bp, Homo sapiens
gagaggcacggaaaccggg

SEQ ID NO: 84104 - DNA, 20 bp, Homo sapiens
gaggctgggcggcgaccggg

SEQ ID NO: 84105 - DNA, 23 bp, Homo sapiens
tagagagcagcatgtggcacaca

SEQ ID NO: 84106 - DNA, 24 bp, Homo sapiens
tagagagcacacacagtccaacgg

SEQ ID NO: 84107 - DNA, 25 bp, Homo sapiens
gagagcacggggcccggcggccggg

SEQ ID NO: 84108 - DNA, 18 bp, Homo sapiens
gagagcacagcaggccgg

SEQ ID NO: 84109 - DNA, 21 bp, Homo sapiens
agagccaccgcggcgaccggg

SEQ ID NO: 84110 - DNA, 25 bp, Homo sapiens
tagagagcatactcggagtcatggg

SEQ ID NO: 84111 - DNA, 21 bp, Homo sapiens
taggagcacacacgtgacggg

SEQ ID NO: 84112 - DNA, 60 bp, Cactus virus X
gttgtcaagggctgtgaacacattggcaatctcgccgacgtcattacggcacttaataac

SEQ ID NO: 84113 - DNA, 24 bp, Cactus virus X
tcaagggctgtgaacacattggca

SEQ ID NO: 84114 - DNA, 19 bp, Homo sapiens
ggctgtaacgccattggca

SEQ ID NO: 84115 - DNA, 21 bp, Homo sapiens
tcagggactgtctcattggca

SEQ ID NO: 84116 - DNA, 17 bp, Homo sapiens
gggctgtgcacaggaac

SEQ ID NO: 84117 - DNA, 17 bp, Homo sapiens
tcaagggctggatttgg

SEQ ID NO: 84118 - DNA, 21 bp, Homo sapiens
tccagggctgttgcattggca

SEQ ID NO: 84119 - DNA, 18 bp, Homo sapiens
ccaggggctgtgaataac

SEQ ID NO: 84120 - DNA, 20 bp, Homo sapiens
tcaagggctgtcaaagatgg

SEQ ID NO: 84121 - DNA, 23 bp, Homo sapiens
aggggtgccagggcacattggca

SEQ ID NO: 84122 - DNA, 20 bp, Homo sapiens
tcaaagtttgagcacattgg

SEQ ID NO: 84123 - DNA, 23 bp, Homo sapiens
aggagccatggagcatattggca

SEQ ID NO: 84124 - DNA, 19 bp, Homo sapiens
actgatgaacacgttggca

SEQ ID NO: 84125 - DNA, 22 bp, Homo sapiens
tcaggggctgcgggcagccggc

SEQ ID NO: 84126 - DNA, 17 bp, Homo sapiens
aagggccgtgggcaggc

SEQ ID NO: 84127 - DNA, 22 bp, Homo sapiens
tcctaggttgtgaacatattgg

SEQ ID NO: 84128 - DNA, 18 bp, Homo sapiens
tccagggctgtggatagc

SEQ ID NO: 84129 - DNA, 19 bp, Homo sapiens
aggatggagtgcattggca

SEQ ID NO: 84130 - DNA, 21 bp, Homo sapiens
gggctgtgatgcacccgttgg

SEQ ID NO: 84131 - DNA, 16 bp, Homo sapiens
agagttgtgaacaagc

SEQ ID NO: 84132 - DNA, 60 bp, Rat cytomegalovirus
ccgctcgatctcggctctgtcggtcgccgtccttcgcgatcgcggtccgttcgggagcgg

SEQ ID NO: 84133 - DNA, 22 bp, Rat cytomegalovirus
atcgcggtccgttcgggagcgg

SEQ ID NO: 84134 - DNA, 20 bp, Homo sapiens
atcgcggctcgtgcccgtgg

SEQ ID NO: 84135 - DNA, 18 bp, Homo sapiens
tcgcggtcccgggagcgg

SEQ ID NO: 84136 - DNA, 21 bp, Homo sapiens
tcgggtaggcggcgggagcgg

SEQ ID NO: 84137 - DNA, 21 bp, Homo sapiens
atcgcggccgttccccgccgg

SEQ ID NO: 84138 - DNA, 20 bp, Homo sapiens
atcggcgggggcgggggcgg

SEQ ID NO: 84139 - DNA, 19 bp, Homo sapiens
accgcggtcggcggggcgg

SEQ ID NO: 84140 - DNA, 15 bp, Homo sapiens
tcgcggccgccggcg

SEQ ID NO: 84141 - DNA, 18 bp, Homo sapiens
tcgcagtcttcagagcgg

SEQ ID NO: 84142 - DNA, 18 bp, Homo sapiens
tcgcggccgtgacggcgg

SEQ ID NO: 84143 - DNA, 16 bp, Homo sapiens
gcggcccgagaggcgg

SEQ ID NO: 84144 - DNA, 18 bp, Homo sapiens
cgcggcggccgggagcgg

SEQ ID NO: 84145 - DNA, 15 bp, Homo sapiens
ccgcggccgggggcg

SEQ ID NO: 84146 - DNA, 18 bp, Homo sapiens
cgcggtccctgggagtgg

SEQ ID NO: 84147 - DNA, 16 bp, Homo sapiens
ccgcgggccgggagcg

SEQ ID NO: 84148 - DNA, 21 bp, Homo sapiens
cgcggtcctcggcgggggcgg

SEQ ID NO: 84149 - DNA, 19 bp, Homo sapiens
tctcggcccacgggggcgg

SEQ ID NO: 84150 - DNA, 17 bp, Homo sapiens
cggtggcttgggagcgg

SEQ ID NO: 84151 - DNA, 16 bp, Homo sapiens
cgcgggcgtgggagcg

SEQ ID NO: 84152 - DNA, 17 bp, Homo sapiens
atcgcggccgctcggcg

SEQ ID NO: 84153 - DNA, 18 bp, Homo sapiens
tcacggtctggccagcgg

SEQ ID NO: 84154 - DNA, 19 bp, Homo sapiens
tcacggcccccgggagcgg

SEQ ID NO: 84155 - DNA, 20 bp, Homo sapiens
tcgcggtcctcccagagcgg

SEQ ID NO: 84156 - DNA, 15 bp, Homo sapiens
cgcggtccgccagcg

SEQ ID NO: 84157 - DNA, 21 bp, Homo sapiens
tcgccgggggttcgggagcgg

SEQ ID NO: 84158 - DNA, 15 bp, Homo sapiens
tcgcggccccgggcg

SEQ ID NO: 84159 - DNA, 15 bp, Homo sapiens
tcgcggccgggggcg

SEQ ID NO: 84160 - DNA, 20 bp, Homo sapiens
tcgcggcccgtttcccgcgg

SEQ ID NO: 84161 - DNA, 21 bp, Homo sapiens
tcccggtccgtccatgggcgg

SEQ ID NO: 84162 - DNA, 106 bp, Swinepox virus
aactaattaattatttaatgtgttttatattatatttttatatattttaatgattaattcataaaaaatgttatagagatataagcgtatgaatatttttttagtt

SEQ ID NO: 84163 - DNA, 24 bp, Swinepox virus
tttaatgtgttttatattatattt

SEQ ID NO: 84164 - DNA, 17 bp, Homo sapiens
tttaatgtgtttatatt

SEQ ID NO: 84165 - DNA, 24 bp, Homo sapiens
tttaatgtgtttattattgtattt

SEQ ID NO: 84166 - DNA, 17 bp, Homo sapiens
gtgtttttactacattt

SEQ ID NO: 84167 - DNA, 18 bp, Homo sapiens
tttaatatgtattatatt

SEQ ID NO: 84168 - DNA, 22 bp, Homo sapiens
ttaatgtgttttaaccagattt

SEQ ID NO: 84169 - DNA, 18 bp, Homo sapiens
tttaatgtgcttaatatt

SEQ ID NO: 84170 - DNA, 86 bp, Equine herpesvirus 1
ggttgtagcgaaatgtccccaacagcggccagtcaacccccttaagcgactgatgcgtggggcatgccgccgctcaaacttaaacc

SEQ ID NO: 84171 - DNA, 24 bp, Equine herpesvirus 1
catgccgccgctcaaacttaaacc

SEQ ID NO: 84172 - DNA, 24 bp, Homo sapiens
catgtctctgctcaggctcaaacc

SEQ ID NO: 84173 - DNA, 21 bp, Homo sapiens
ataccccaacaaacttaaacc

SEQ ID NO: 84174 - DNA, 22 bp, Homo sapiens
tgccgccgcttggctctggacc

SEQ ID NO: 84175 - DNA, 19 bp, Homo sapiens
gccacaacaaacttaaacc

SEQ ID NO: 84176 - DNA, 24 bp, Homo sapiens
catgccactgcccgcaggaactta

SEQ ID NO: 84177 - DNA, 20 bp, Homo sapiens
gccgccgctatctctggacc

SEQ ID NO: 84178 - DNA, 20 bp, Homo sapiens
tgccgccgcttccccagacc

SEQ ID NO: 84179 - DNA, 18 bp, Homo sapiens
gctgcatcaaacttgaac

SEQ ID NO: 84180 - DNA, 19 bp, Homo sapiens
gccacacaaggcttaaacc

SEQ ID NO: 84181 - DNA, 60 bp, Equine herpesvirus 1
tacccgtaaataagcacgctttaaatcaaacaacaacaggttgtatggctgtaaagggta

SEQ ID NO: 84182 - DNA, 18 bp, Equine herpesvirus 1
gtatggctgtaaagggta

SEQ ID NO: 84183 - DNA, 18 bp, Homo sapiens
tatgttctataaagggta

SEQ ID NO: 84184 - DNA, 20 bp, Homo sapiens
gtatgactattaggagggta

SEQ ID NO: 84185 - DNA, 16 bp, Homo sapiens
atatgactcaagggta

SEQ ID NO: 84186 - DNA, 15 bp, Homo sapiens
gtaggccaaagggta

SEQ ID NO: 84187 - DNA, 19 bp, Homo sapiens
tatggctgggatcaaaggg

SEQ ID NO: 84188 - DNA, 18 bp, Homo sapiens
gtattttgctaaagggta

SEQ ID NO: 84189 - DNA, 15 bp, Homo sapiens
gtaggtgaaagggta

SEQ ID NO: 84190 - DNA, 17 bp, Homo sapiens
gtatattgtagagggta

SEQ ID NO: 84191 - DNA, 19 bp, Homo sapiens
tatggctgctgtgagggta

SEQ ID NO: 84192 - DNA, 16 bp, Homo sapiens
gtaggttgaaagggta

SEQ ID NO: 84193 - DNA, 22 bp, Homo sapiens
gcatggctggaagccaagggta

SEQ ID NO: 84194 - DNA, 19 bp, Homo sapiens
gcatggctgcactctggta

SEQ ID NO: 84195 - DNA, 18 bp, Homo sapiens
gtaggttggaaaagggta

SEQ ID NO: 84196 - DNA, 15 bp, Homo sapiens
gttaggtaaagggta

SEQ ID NO: 84197 - DNA, 25 bp, Homo sapiens
gtatggctctgatcaagaagggtat

SEQ ID NO: 84198 - DNA, 19 bp, Homo sapiens
gtatggctaccttcagggt

SEQ ID NO: 84199 - DNA, 19 bp, Homo sapiens
ataaagctttgtagagggt

SEQ ID NO: 84200 - DNA, 21 bp, Homo sapiens
tatggctgtgggacaaagggt

SEQ ID NO: 84201 - DNA, 20 bp, Homo sapiens
gcatggccattcagagggta

SEQ ID NO: 84202 - DNA, 20 bp, Homo sapiens
gtgtgtttgtaaagagggta

SEQ ID NO: 84203 - DNA, 17 bp, Homo sapiens
gtcagaagtaaagggta

SEQ ID NO: 84204 - DNA, 18 bp, Homo sapiens
ggagctacttaaagggta

SEQ ID NO: 84205 - DNA, 18 bp, Homo sapiens
gtatagctgctgcagggt

SEQ ID NO: 84206 - DNA, 17 bp, Homo sapiens
gtatggctgaaagaata

SEQ ID NO: 84207 - DNA, 17 bp, Homo sapiens
gtatgtaataaagggta

SEQ ID NO: 84208 - DNA, 17 bp, Homo sapiens
gtaggcatgaaagggta

SEQ ID NO: 84209 - DNA, 15 bp, Homo sapiens
gataactaaagggta

SEQ ID NO: 84210 - DNA, 17 bp, Homo sapiens
atattctgtaaagggta

SEQ ID NO: 84211 - DNA, 74 bp, Zucchini yellow mosaic virus
gtgtttacaaacaagcaatctataattcgcacagcatcaagaatttctgcaatcactttgtttattttagacac

SEQ ID NO: 84212 - DNA, 23 bp, Zucchini yellow mosaic virus
atcactttgtttattttagacac

SEQ ID NO: 84213 - DNA, 22 bp, Homo sapiens
atcactcttgtttataaatcac

SEQ ID NO: 84214 - DNA, 21 bp, Homo sapiens
atcactttgctttatttgaca

SEQ ID NO: 84215 - DNA, 21 bp, Homo sapiens
tcactttgtttaagcaaacac

SEQ ID NO: 84216 - DNA, 20 bp, Homo sapiens
tcgcttttgttcttagacac

SEQ ID NO: 84217 - DNA, 18 bp, Homo sapiens
cagcttgtttattttaga

SEQ ID NO: 84218 - DNA, 18 bp, Homo sapiens
ctttgtttgtttagacac

SEQ ID NO: 84219 - DNA, 21 bp, Homo sapiens
actttgtttcgaacgtagaca

SEQ ID NO: 84220 - DNA, 20 bp, Homo sapiens
tcactttgtaggattaggca

SEQ ID NO: 84221 - DNA, 24 bp, Homo sapiens
atcactttctttagtaataagaca

SEQ ID NO: 84222 - DNA, 19 bp, Homo sapiens
atcaccactgttttagaca

SEQ ID NO: 84223 - DNA, 19 bp, Homo sapiens
atcacttggtttattctga

SEQ ID NO: 84224 - DNA, 18 bp, Homo sapiens
ctttaactttttagacac

SEQ ID NO: 84225 - DNA, 16 bp, Homo sapiens
actttgtttattaaca

SEQ ID NO: 84226 - DNA, 22 bp, Homo sapiens
acatttgtaaatattttagaca

SEQ ID NO: 84227 - DNA, 16 bp, Homo sapiens
tcacccttattttaga

SEQ ID NO: 84228 - DNA, 18 bp, Homo sapiens
tttgtttgttttagacac

SEQ ID NO: 84229 - DNA, 19 bp, Homo sapiens
actttgtttatacttacac

SEQ ID NO: 84230 - DNA, 21 bp, Homo sapiens
cattttgaagcttttagacac

SEQ ID NO: 84231 - DNA, 17 bp, Homo sapiens
ccactttgtttatgaca

SEQ ID NO: 84232 - DNA, 16 bp, Homo sapiens
actttgtttataagac

SEQ ID NO: 84233 - DNA, 21 bp, Homo sapiens
atcattcccgtttttagacac

SEQ ID NO: 84234 - DNA, 117 bp, African swine fever virus
gaaatatccttagaagcatgtctttcggcagagccattaccggtagcaaaaaagcaacattgagtatattatatgccttagcctgctcataagcgtccttttttttcatggtatttt

SEQ ID NO: 84235 - DNA, 24 bp, African swine fever virus
tgagtatattatatgccttagcct

SEQ ID NO: 84236 - DNA, 21 bp, Homo sapiens
tgaatatattatcctattggc

SEQ ID NO: 84237 - DNA, 18 bp, Homo sapiens
agtatatccttccttagc

SEQ ID NO: 84238 - DNA, 20 bp, Homo sapiens
agtatattatatattttagc

SEQ ID NO: 84239 - DNA, 16 bp, Homo sapiens
tgaatatataccttag

SEQ ID NO: 84240 - DNA, 19 bp, Homo sapiens
tgagtatattgtgtgctgc

SEQ ID NO: 84241 - DNA, 18 bp, Homo sapiens
tgagtatttatatgcact

SEQ ID NO: 84242 - DNA, 96 bp, Gallid herpesvirus 3
gcgacgggccgttacgtttcaccgtgttgcgtctccgacactgatcaagctgttcacggcaatgacattcttatacgggaacagtagcgcccacgc

SEQ ID NO: 84243 - DNA, 24 bp, Gallid herpesvirus 3
caccgtgttgcgtctccgacactg

SEQ ID NO: 84244 - DNA, 21 bp, Homo sapiens
accgtgttctgtacaatactg

SEQ ID NO: 84245 - DNA, 21 bp, Homo sapiens
cactgtgtagcattgatactg

SEQ ID NO: 84246 - DNA, 19 bp, Homo sapiens
gtgttgcatgttgatactg

SEQ ID NO: 84247 - DNA, 20 bp, Homo sapiens
gctgtgtccctctgacactg

SEQ ID NO: 84248 - DNA, 19 bp, Homo sapiens
caccgtgccttccggcgct

SEQ ID NO: 84249 - DNA, 17 bp, Homo sapiens
gtgtgatctccgatgct

SEQ ID NO: 84250 - DNA, 23 bp, Homo sapiens
ccagtgctgcgtctttggcactg

SEQ ID NO: 84251 - DNA, 20 bp, Homo sapiens
atgtgacatctccgacactg

SEQ ID NO: 84252 - DNA, 20 bp, Homo sapiens
catgttggtttccgacgctg

SEQ ID NO: 84253 - DNA, 17 bp, Homo sapiens
gtgctgtgcccgcactg

SEQ ID NO: 84254 - DNA, 19 bp, Homo sapiens
caccgtgcactccggcgct

SEQ ID NO: 84255 - DNA, 23 bp, Homo sapiens
ccagcactgcgtctctggcactg

SEQ ID NO: 84256 - DNA, 23 bp, Homo sapiens
ccagtgctgcgtctctgacactg

SEQ ID NO: 84257 - DNA, 17 bp, Homo sapiens
gcatcgtttctgacact

SEQ ID NO: 84258 - DNA, 73 bp, Respiratory syncytial virus
ctccatagttcaaatggagcctgaaaattatagtaatttaaaattaaggagagacataagatgaaagatgggg

SEQ ID NO: 84259 - DNA, 24 bp, Respiratory syncytial virus
ttcaaatggagcctgaaaattata

SEQ ID NO: 84260 - DNA, 20 bp, Homo sapiens
ttcaatggagcatttattat

SEQ ID NO: 84261 - DNA, 19 bp, Homo sapiens
aattaagctgaaaattata

SEQ ID NO: 84262 - DNA, 19 bp, Homo sapiens
ttcaaaggaagaaaattat

SEQ ID NO: 84263 - DNA, 19 bp, Homo sapiens
ttcaaatggagtaaatgaa

SEQ ID NO: 84264 - DNA, 19 bp, Homo sapiens
ttcaaatgaagtaaatgaa

SEQ ID NO: 84265 - DNA, 22 bp, Homo sapiens
ttcaaatggattctttcctata

SEQ ID NO: 84266 - DNA, 22 bp, Homo sapiens
tcaagtggtacagaaaattata

SEQ ID NO: 84267 - DNA, 21 bp, Homo sapiens
aaacggagtctggctcttata

SEQ ID NO: 84268 - DNA, 18 bp, Homo sapiens
atggcactgaaaattata

SEQ ID NO: 84269 - DNA, 20 bp, Homo sapiens
aatggagcccatccattata

SEQ ID NO: 84270 - DNA, 87 bp, African swine fever virus
taacatgcaaaaaaaatatgtttaaacttattttaagctagcacttatttaaaagcttgttttaaacacgttttaaattgtatgtta

SEQ ID NO: 84271 - DNA, 24 bp, African swine fever virus
tttaaacttattttaagctagcac

SEQ ID NO: 84272 - DNA, 19 bp, Homo sapiens
tttaactttattttaagct

SEQ ID NO: 84273 - DNA, 21 bp, Homo sapiens
ttaagacttattttggccagc

SEQ ID NO: 84274 - DNA, 19 bp, Homo sapiens
tttaaactttttttagcca

SEQ ID NO: 84275 - DNA, 21 bp, Homo sapiens
tcaaaactaattgagctagca

SEQ ID NO: 84276 - DNA, 19 bp, Homo sapiens
tttaaacttatcttcaagc

SEQ ID NO: 84277 - DNA, 76 bp, Cowpox virus
cattaaattatcatttttgaatgtatttataccagatcaaaaacttgtacaattattaataaaaaataatttagtg

SEQ ID NO: 84278 - DNA, 24 bp, Cowpox virus
taaattatcatttttgaatgtatt

SEQ ID NO: 84279 - DNA, 19 bp, Homo sapiens
taaattatcatctttgaat

SEQ ID NO: 84280 - DNA, 22 bp, Homo sapiens
tgattatctgggtgaatgtatt

SEQ ID NO: 84281 - DNA, 17 bp, Homo sapiens
taaattatcattttgaa

SEQ ID NO: 84282 - DNA, 20 bp, Homo sapiens
taagctatcatttttgaaca

SEQ ID NO: 84283 - DNA, 21 bp, Homo sapiens
taaattactaatgaatgtatt

SEQ ID NO: 84284 - DNA, 18 bp, Homo sapiens
taaattatcctttttgaa

SEQ ID NO: 84285 - DNA, 20 bp, Homo sapiens
ctatcatttttgtaaatatt

SEQ ID NO: 84286 - DNA, 18 bp, Homo sapiens
aattatcattttgaatgt

SEQ ID NO: 84287 - DNA, 69 bp, Vaccinia virus
ctggtataaagatgttagattagttaatgggaatcgtctataataatgaatattaaacaattatatgag

SEQ ID NO: 84288 - DNA, 19 bp, Vaccinia virus
tattaaacaattatatgag

SEQ ID NO: 84289 - DNA, 20 bp, Homo sapiens
cattaaacacggtatatgag

SEQ ID NO: 84290 - DNA, 19 bp, Homo sapiens
tattaaacatttatttgag

SEQ ID NO: 84291 - DNA, 87 bp, Cowpox virus
ttgattttctttctaatactatatatttctctcgaagaagttcttgcacatcatctgggaataaaatactactgttgagtaaatcag

SEQ ID NO: 84292 - DNA, 89 bp, Rat cytomegalovirus
tctccggtctccataactcgctctcgcctggagcttttatatactaacgtgtgatgagcacctccccagggaagatgatgacgccgaga

SEQ ID NO: 84293 - DNA, 24 bp, Rat cytomegalovirus
tgagcacctccccagggaagatga

SEQ ID NO: 84294 - DNA, 20 bp, Homo sapiens
tgggcacctccccagtacag

SEQ ID NO: 84295 - DNA, 23 bp, Homo sapiens
tgagcacccggatatggaagatg

SEQ ID NO: 84296 - DNA, 22 bp, Homo sapiens
gaggagaaccccagggaagatg

SEQ ID NO: 84297 - DNA, 19 bp, Homo sapiens
tgaacacctccccgcctgg

SEQ ID NO: 84298 - DNA, 20 bp, Homo sapiens
ccagttcccagggaaggtga

SEQ ID NO: 84299 - DNA, 23 bp, Homo sapiens
tgagcacctcctcgggctccagg

SEQ ID NO: 84300 - DNA, 24 bp, Homo sapiens
cacctccctggggtccgggagatg

SEQ ID NO: 84301 - DNA, 19 bp, Homo sapiens
tgagcaccttcagccagag

SEQ ID NO: 84302 - DNA, 16 bp, Homo sapiens
tgagacaagggaagat

SEQ ID NO: 84303 - DNA, 20 bp, Homo sapiens
gccaaaccccaggggagatg

SEQ ID NO: 84304 - DNA, 23 bp, Homo sapiens
tgaggctggagccagggaaggtg

SEQ ID NO: 84305 - DNA, 22 bp, Homo sapiens
tggcacagtactggggaagatg

SEQ ID NO: 84306 - DNA, 19 bp, Homo sapiens
gcagcctctagggaagatg

SEQ ID NO: 84307 - DNA, 23 bp, Homo sapiens
tgaacatttccccagaaaagtga

SEQ ID NO: 84308 - DNA, 18 bp, Homo sapiens
tgagcacctctcgcaggg

SEQ ID NO: 84309 - DNA, 16 bp, Homo sapiens
gagcacagggaagatg

SEQ ID NO: 84310 - DNA, 18 bp, Homo sapiens
tggcacctcccaaggtga

SEQ ID NO: 84311 - DNA, 19 bp, Homo sapiens
aagcaccttgtgaagatga

SEQ ID NO: 84312 - DNA, 23 bp, Homo sapiens
gcagcctttctcagggaagatga

SEQ ID NO: 84313 - DNA, 22 bp, Homo sapiens
tgagcacctttcccaggttaga

SEQ ID NO: 84314 - DNA, 18 bp, Homo sapiens
gagcccgggccccaggga

SEQ ID NO: 84315 - DNA, 21 bp, Homo sapiens
gcacctttcccagggagatga

SEQ ID NO: 84316 - DNA, 21 bp, Homo sapiens
tgagggcctgggaggaagatg

SEQ ID NO: 84317 - DNA, 19 bp, Homo sapiens
tgagaacctcccaaagatg

SEQ ID NO: 84318 - DNA, 23 bp, Homo sapiens
gcaccctttctcggggaagatga

SEQ ID NO: 84319 - DNA, 22 bp, Homo sapiens
tggctgccttccagagaaggtg

SEQ ID NO: 84320 - DNA, 18 bp, Homo sapiens
tgaacaccttttcaagga

SEQ ID NO: 84321 - DNA, 71 bp, Tupaia herpesvirus
ggcggcggggcagcggcgcgggcgacgggagcgagagggcgagcgaccggtccgcgctcgggccccccgcc

SEQ ID NO: 84322 - DNA, 21 bp, Tupaia herpesvirus
tccgcgctcgggccccccgcc

SEQ ID NO: 84323 - DNA, 19 bp, Homo sapiens
tccctcagagtcccccgcc

SEQ ID NO: 84324 - DNA, 16 bp, Homo sapiens
tccgcgctggctccgc

SEQ ID NO: 84325 - DNA, 19 bp, Homo sapiens
tccacgctccctacccgcc

SEQ ID NO: 84326 - DNA, 21 bp, Homo sapiens
tccatgctcggactctctgcc

SEQ ID NO: 84327 - DNA, 20 bp, Homo sapiens
ccgcgcccctacctcccgcc

SEQ ID NO: 84328 - DNA, 21 bp, Homo sapiens
cccgcgcagccgcctcctgcc

SEQ ID NO: 84329 - DNA, 19 bp, Homo sapiens
tccacgctgccacctcgcc

SEQ ID NO: 84330 - DNA, 22 bp, Homo sapiens
tccacaccacagggccttctgc

SEQ ID NO: 84331 - DNA, 21 bp, Homo sapiens
tccggcagcctcctccccgcc

SEQ ID NO: 84332 - DNA, 19 bp, Homo sapiens
tccgccgctcacgcccgcc

SEQ ID NO: 84333 - DNA, 17 bp, Homo sapiens
cccagcagccccccgcc

SEQ ID NO: 84334 - DNA, 18 bp, Homo sapiens
cccgcgaggccccctgcc

SEQ ID NO: 84335 - DNA, 17 bp, Homo sapiens
tcctgctgccccccgcc

SEQ ID NO: 84336 - DNA, 18 bp, Homo sapiens
cccgcgctcggcgccgcc

SEQ ID NO: 84337 - DNA, 20 bp, Homo sapiens
tcggcgccgccatttcccgc

SEQ ID NO: 84338 - DNA, 16 bp, Homo sapiens
tccgcttcgggcccgc

SEQ ID NO: 84339 - DNA, 18 bp, Homo sapiens
tccgcgctcggctctcgc

SEQ ID NO: 84340 - DNA, 18 bp, Homo sapiens
cctgcaaagccccccgcc

SEQ ID NO: 84341 - DNA, 20 bp, Homo sapiens
ccgcgcaggcccctcccgcc

SEQ ID NO: 84342 - DNA, 20 bp, Homo sapiens
tccgcgccacagctcccgcc

SEQ ID NO: 84343 - DNA, 19 bp, Homo sapiens
tccgcgcctgccgcctgcc

SEQ ID NO: 84344 - DNA, 17 bp, Homo sapiens
tccgccggagcctccgc

SEQ ID NO: 84345 - DNA, 20 bp, Homo sapiens
cccccaatgggccccccgcc

SEQ ID NO: 84346 - DNA, 17 bp, Homo sapiens
cccgcgccggctcccgc

SEQ ID NO: 84347 - DNA, 18 bp, Homo sapiens
tcccgctccggatcccgc

SEQ ID NO: 84348 - DNA, 19 bp, Homo sapiens
tcccgctctggatcccgcc

SEQ ID NO: 84349 - DNA, 18 bp, Homo sapiens
tccatcgctgctcctcgc

SEQ ID NO: 84350 - DNA, 17 bp, Homo sapiens
ccgcgctcggccccgcc

SEQ ID NO: 84351 - DNA, 21 bp, Homo sapiens
tcagcaaaggggccccctgcc

SEQ ID NO: 84352 - DNA, 19 bp, Homo sapiens
tccccgtcgtacccccgcc

SEQ ID NO: 84353 - DNA, 16 bp, Homo sapiens
tccgcgcctggcccgc

SEQ ID NO: 84354 - DNA, 21 bp, Homo sapiens
tccgcctcggccgcccccgcc

SEQ ID NO: 84355 - DNA, 22 bp, Homo sapiens
cccgcgctcccggcttctccgc

SEQ ID NO: 84356 - DNA, 23 bp, Homo sapiens
tccacgctcggatgggaccctgc

SEQ ID NO: 84357 - DNA, 17 bp, Homo sapiens
ccgcgccggcccccgcc

SEQ ID NO: 84358 - DNA, 19 bp, Homo sapiens
cccgcgccgacttcctgcc

SEQ ID NO: 84359 - DNA, 19 bp, Homo sapiens
gcgccccgggccccctgcc

SEQ ID NO: 84360 - DNA, 20 bp, Homo sapiens
ccctggcggggccccctgcc

SEQ ID NO: 84361 - DNA, 17 bp, Homo sapiens
tccccgcaggcccctgc

SEQ ID NO: 84362 - DNA, 19 bp, Homo sapiens
cctggccaggctccctgcc

SEQ ID NO: 84363 - DNA, 19 bp, Homo sapiens
ccgcgccgcctcccccgcc

SEQ ID NO: 84364 - DNA, 19 bp, Homo sapiens
tccgcgcccggcgtccgcc

SEQ ID NO: 84365 - DNA, 20 bp, Homo sapiens
tccttggcgccccccccgcc

SEQ ID NO: 84366 - DNA, 16 bp, Homo sapiens
cgcgctcgggccgcgc

SEQ ID NO: 84367 - DNA, 20 bp, Homo sapiens
ccgccgcggggctccttgcc

SEQ ID NO: 84368 - DNA, 20 bp, Homo sapiens
tccgcgccgggccgggaagc

SEQ ID NO: 84369 - DNA, 18 bp, Homo sapiens
cccgcgcccccctccgcc

SEQ ID NO: 84370 - DNA, 15 bp, Homo sapiens
cccgcgctcggccgc

SEQ ID NO: 84371 - DNA, 20 bp, Homo sapiens
tccacgctgcgtctcctgcc

SEQ ID NO: 84372 - DNA, 18 bp, Homo sapiens
gcgctcgggcccggccgc

SEQ ID NO: 84373 - DNA, 20 bp, Homo sapiens
cccgcgcccccgcccccgcc

SEQ ID NO: 84374 - DNA, 20 bp, Homo sapiens
tcctgcctcctccccccgcc

SEQ ID NO: 84375 - DNA, 21 bp, Homo sapiens
tccggccggaccctcctcgcc

SEQ ID NO: 84376 - DNA, 21 bp, Homo sapiens
tccgcgccgggggagggcgcc

SEQ ID NO: 84377 - DNA, 20 bp, Homo sapiens
cccagcaggggtcccccgcc

SEQ ID NO: 84378 - DNA, 18 bp, Homo sapiens
cccgcgcccgccctcgcc

SEQ ID NO: 84379 - DNA, 17 bp, Homo sapiens
cctgccgggccctccgc

SEQ ID NO: 84380 - DNA, 16 bp, Homo sapiens
cccgcgctcctcccgc

SEQ ID NO: 84381 - DNA, 19 bp, Homo sapiens
cccgtaggcgccccccgcc

SEQ ID NO: 84382 - DNA, 16 bp, Homo sapiens
tcccgccggcccccgc

SEQ ID NO: 84383 - DNA, 19 bp, Homo sapiens
gcgcggcccctcccccgcc

SEQ ID NO: 84384 - DNA, 22 bp, Homo sapiens
tccgcgccacgccctccccgcc

SEQ ID NO: 84385 - DNA, 23 bp, Homo sapiens
cctgcgctccacacatcctcgcc

SEQ ID NO: 84386 - DNA, 17 bp, Homo sapiens
ccgcgctcacctccgcc

SEQ ID NO: 84387 - DNA, 20 bp, Homo sapiens
cccgcgccccagcccccgcc

SEQ ID NO: 84388 - DNA, 18 bp, Homo sapiens
cccgcggggctcccctgc

SEQ ID NO: 84389 - DNA, 19 bp, Homo sapiens
tccgcctcgctcccctgcc

SEQ ID NO: 84390 - DNA, 19 bp, Homo sapiens
ccgcgctctgcctcctgcc

SEQ ID NO: 84391 - DNA, 17 bp, Homo sapiens
tccgcgcccctcccgcc

SEQ ID NO: 84392 - DNA, 17 bp, Homo sapiens
cccgcgctcggctccgc

SEQ ID NO: 84393 - DNA, 19 bp, Homo sapiens
tccgcgccggggaagcgcc

SEQ ID NO: 84394 - DNA, 18 bp, Homo sapiens
tccgacgttccccccgcc

SEQ ID NO: 84395 - DNA, 19 bp, Homo sapiens
tccgcgcccaccgccccgc

SEQ ID NO: 84396 - DNA, 23 bp, Homo sapiens
tccgcgcccgcgcccttccccgc

SEQ ID NO: 84397 - DNA, 19 bp, Homo sapiens
cggcgcgagctcccccgcc

SEQ ID NO: 84398 - DNA, 18 bp, Homo sapiens
ccggccaggccccctgcc

SEQ ID NO: 84399 - DNA, 18 bp, Homo sapiens
tccttgctcaggctccgc

SEQ ID NO: 84400 - DNA, 19 bp, Homo sapiens
tccgcccccgcccttcgcc

SEQ ID NO: 84401 - DNA, 16 bp, Homo sapiens
cccgcgctcgtcccgc

SEQ ID NO: 84402 - DNA, 18 bp, Homo sapiens
cgccctcggcccctcgcc

SEQ ID NO: 84403 - DNA, 19 bp, Homo sapiens
tccaaggcggtcccccgcc

SEQ ID NO: 84404 - DNA, 19 bp, Homo sapiens
tccgtcgccaacccccgcc

SEQ ID NO: 84405 - DNA, 19 bp, Homo sapiens
tccgcctcccacccccgcc

SEQ ID NO: 84406 - DNA, 18 bp, Homo sapiens
cccgcgctcccctccgcc

SEQ ID NO: 84407 - DNA, 18 bp, Homo sapiens
tccggctcgggccccgcc

SEQ ID NO: 84408 - DNA, 21 bp, Homo sapiens
gctgcccggacggcctcccgc

SEQ ID NO: 84409 - DNA, 21 bp, Homo sapiens
tcctgctgcaggccccctgcc

SEQ ID NO: 84410 - DNA, 15 bp, Homo sapiens
tccagcgccccccgc

SEQ ID NO: 84411 - DNA, 18 bp, Homo sapiens
cccgcgcccgcctccgcc

SEQ ID NO: 84412 - DNA, 18 bp, Homo sapiens
cccgcgctccggttcgcc

SEQ ID NO: 84413 - DNA, 21 bp, Homo sapiens
cccgcgtcggactccctccgc

SEQ ID NO: 84414 - DNA, 22 bp, Homo sapiens
cccgaaccgtgggcctcccgcc

SEQ ID NO: 84415 - DNA, 20 bp, Homo sapiens
ccgcgccgaagtcctccgcc

SEQ ID NO: 84416 - DNA, 19 bp, Homo sapiens
ccgcgcccccgccccccgc

SEQ ID NO: 84417 - DNA, 19 bp, Homo sapiens
tcctctcaagcccctcgcc

SEQ ID NO: 84418 - DNA, 19 bp, Homo sapiens
tccgcgcctgagcctcgcc

SEQ ID NO: 84419 - DNA, 20 bp, Homo sapiens
tccaccgcccgccccccgcc

SEQ ID NO: 84420 - DNA, 20 bp, Homo sapiens
tccgcactcctcttcccgcc

SEQ ID NO: 84421 - DNA, 18 bp, Homo sapiens
ccgcgctcggctcccgcc

SEQ ID NO: 84422 - DNA, 16 bp, Homo sapiens
tccggggctcccccgc

SEQ ID NO: 84423 - DNA, 19 bp, Homo sapiens
tccgcgctccggcggcgcc

SEQ ID NO: 84424 - DNA, 22 bp, Homo sapiens
cctgcggagctgggcctcctgc

SEQ ID NO: 84425 - DNA, 15 bp, Homo sapiens
cccgccgccccccgc

SEQ ID NO: 84426 - DNA, 19 bp, Homo sapiens
tccgtctcctgcccccgcc

SEQ ID NO: 84427 - DNA, 17 bp, Homo sapiens
tccgtgccaagcccgcc

SEQ ID NO: 84428 - DNA, 22 bp, Homo sapiens
tccccgccctgcgctctccgcc

SEQ ID NO: 84429 - DNA, 19 bp, Homo sapiens
cccgcgctcggcccccgcc

SEQ ID NO: 84430 - DNA, 18 bp, Homo sapiens
cccgcgctcccgcccgcc

SEQ ID NO: 84431 - DNA, 19 bp, Homo sapiens
tccagcccaagccctccgc

SEQ ID NO: 84432 - DNA, 18 bp, Homo sapiens
cgctccagcccctccgcc

SEQ ID NO: 84433 - DNA, 16 bp, Homo sapiens
tccgcgctggtcccgc

SEQ ID NO: 84434 - DNA, 19 bp, Homo sapiens
tccggctccaggccccgcc

SEQ ID NO: 84435 - DNA, 16 bp, Homo sapiens
ccctgcaagcccccgc

SEQ ID NO: 84436 - DNA, 17 bp, Homo sapiens
tccttgcaagcccccgc

SEQ ID NO: 84437 - DNA, 17 bp, Homo sapiens
cccgcgctctgcccgcc

SEQ ID NO: 84438 - DNA, 15 bp, Homo sapiens
ccgcgcgccccccgc

SEQ ID NO: 84439 - DNA, 20 bp, Homo sapiens
tccgcacgcccgcccccgcc

SEQ ID NO: 84440 - DNA, 19 bp, Homo sapiens
tccgcgcccggggcggcgc

SEQ ID NO: 84441 - DNA, 23 bp, Homo sapiens
tcggcgctcccgggcctcctcgc

SEQ ID NO: 84442 - DNA, 18 bp, Homo sapiens
tcctcgctcgctcccgcc

SEQ ID NO: 84443 - DNA, 17 bp, Homo sapiens
cgcgccctccccccgcc

SEQ ID NO: 84444 - DNA, 20 bp, Homo sapiens
cccgcgccctcgccctcgcc

SEQ ID NO: 84445 - DNA, 19 bp, Homo sapiens
tccagtagggtcccccgcc

SEQ ID NO: 84446 - DNA, 18 bp, Homo sapiens
gctgccaggcccctcgcc

SEQ ID NO: 84447 - DNA, 21 bp, Homo sapiens
ccgcggccccggtcccctgcc

SEQ ID NO: 84448 - DNA, 18 bp, Homo sapiens
gcactcggtgcctccgcc

SEQ ID NO: 84449 - DNA, 19 bp, Homo sapiens
cccgcgctcagccctcgcc

SEQ ID NO: 84450 - DNA, 20 bp, Homo sapiens
tccgggccccgccccctcgc

SEQ ID NO: 84451 - DNA, 15 bp, Homo sapiens
tccggccgcccccgc

SEQ ID NO: 84452 - DNA, 15 bp, Homo sapiens
cgcgccgcccccgcc

SEQ ID NO: 84453 - DNA, 18 bp, Homo sapiens
cctgcccagctccctgcc

SEQ ID NO: 84454 - DNA, 19 bp, Homo sapiens
tcccccccaggcctcctgc

SEQ ID NO: 84455 - DNA, 15 bp, Homo sapiens
cggcccgccccccgc

SEQ ID NO: 84456 - DNA, 16 bp, Homo sapiens
tccacgctcaccctgc

SEQ ID NO: 84457 - DNA, 18 bp, Homo sapiens
tccggccgctcccccgcc

SEQ ID NO: 84458 - DNA, 16 bp, Homo sapiens
cccgcgctgctcccgc

SEQ ID NO: 84459 - DNA, 19 bp, Homo sapiens
tcccgctcaggcctcccgc

SEQ ID NO: 84460 - DNA, 18 bp, Homo sapiens
cccgcgctgcctcccgcc

SEQ ID NO: 84461 - DNA, 22 bp, Homo sapiens
tccggctcgggctgcggccgcc

SEQ ID NO: 84462 - DNA, 19 bp, Homo sapiens
tccacgctctgccccttgc

SEQ ID NO: 84463 - DNA, 19 bp, Homo sapiens
tccgcggagaccccccgcc

SEQ ID NO: 84464 - DNA, 21 bp, Homo sapiens
tccggcgccgccacccccgcc

SEQ ID NO: 84465 - DNA, 22 bp, Homo sapiens
tccgcggctctgctctcctgcc

SEQ ID NO: 84466 - DNA, 15 bp, Homo sapiens
cccgcgctcccccgc

SEQ ID NO: 84467 - DNA, 18 bp, Homo sapiens
ccgcgctgctcccccgcc

SEQ ID NO: 84468 - DNA, 20 bp, Homo sapiens
ccgtgcttcaggcccccgcc

SEQ ID NO: 84469 - DNA, 20 bp, Homo sapiens
tccggccgccccctccccgc

SEQ ID NO: 84470 - DNA, 19 bp, Homo sapiens
gccgcccaggcctcccgcc

SEQ ID NO: 84471 - DNA, 18 bp, Homo sapiens
ccgcgctctctggcccgc

SEQ ID NO: 84472 - DNA, 22 bp, Homo sapiens
tccgcgcccgccgagcctcgcc

SEQ ID NO: 84473 - DNA, 18 bp, Homo sapiens
tcccgccgccccttcgcc

SEQ ID NO: 84474 - DNA, 21 bp, Homo sapiens
cccgcgctctccccctccgcc

SEQ ID NO: 84475 - DNA, 23 bp, Homo sapiens
cccgcgctcggctacagcctgcc

SEQ ID NO: 84476 - DNA, 24 bp, Homo sapiens
cccgcgctcgggccgcccctcgcc

SEQ ID NO: 84477 - DNA, 17 bp, Homo sapiens
cccgcgccggctcctgc

SEQ ID NO: 84478 - DNA, 17 bp, Homo sapiens
ccgcgccccctcccgcc

SEQ ID NO: 84479 - DNA, 18 bp, Homo sapiens
ccgcgctccggctccgcc

SEQ ID NO: 84480 - DNA, 20 bp, Homo sapiens
cccgcgcctcagctcccgcc

SEQ ID NO: 84481 - DNA, 21 bp, Homo sapiens
tcctcgcccccgccccccgcc

SEQ ID NO: 84482 - DNA, 21 bp, Homo sapiens
tccgcgccgcccgctcccgcc

SEQ ID NO: 84483 - DNA, 15 bp, Homo sapiens
gcgctcacccccgcc

SEQ ID NO: 84484 - DNA, 19 bp, Homo sapiens
cccgtaactgcttcccgcc

SEQ ID NO: 84485 - DNA, 18 bp, Homo sapiens
ccgcgctcccggcccgcc

SEQ ID NO: 84486 - DNA, 20 bp, Homo sapiens
tccagcggggaccccccgcc

SEQ ID NO: 84487 - DNA, 16 bp, Homo sapiens
cccgctggccctccgc

SEQ ID NO: 84488 - DNA, 19 bp, Homo sapiens
tccggccgggccccccgcc

SEQ ID NO: 84489 - DNA, 17 bp, Homo sapiens
cccgcgcccgcctccgc

SEQ ID NO: 84490 - DNA, 19 bp, Homo sapiens
cgaacccgggccccccgcc

SEQ ID NO: 84491 - DNA, 20 bp, Homo sapiens
tccgcctgcccgcccccgcc

SEQ ID NO: 84492 - DNA, 19 bp, Homo sapiens
cgcgctcgggcacatcgcc

SEQ ID NO: 84493 - DNA, 16 bp, Homo sapiens
ccgcgctcagccccgc

SEQ ID NO: 84494 - DNA, 19 bp, Homo sapiens
cccgcgccgagctcccgcc

SEQ ID NO: 84495 - DNA, 19 bp, Homo sapiens
tccacgctctcgggttcgc

SEQ ID NO: 84496 - DNA, 16 bp, Homo sapiens
tccgcgcccaccctcg

SEQ ID NO: 84497 - DNA, 20 bp, Homo sapiens
cccgcgcctcctcctccgcc

SEQ ID NO: 84498 - DNA, 23 bp, Homo sapiens
tccacgccgccgcggctcctcgc

SEQ ID NO: 84499 - DNA, 19 bp, Homo sapiens
ccgttggcagcctcccgcc

SEQ ID NO: 84500 - DNA, 21 bp, Homo sapiens
tccggccgagccctccccgcc

SEQ ID NO: 84501 - DNA, 21 bp, Homo sapiens
tccacgctgtccagtctccgc

SEQ ID NO: 84502 - DNA, 19 bp, Homo sapiens
tccgggccccctccccgcc

SEQ ID NO: 84503 - DNA, 18 bp, Homo sapiens
gcactcaggcttcccgcc

SEQ ID NO: 84504 - DNA, 18 bp, Homo sapiens
tccatgcctgcccccgcc

SEQ ID NO: 84505 - DNA, 16 bp, Homo sapiens
cgcactcggccccgcc

SEQ ID NO: 84506 - DNA, 19 bp, Homo sapiens
tccgagccccgcccctgcc

SEQ ID NO: 84507 - DNA, 20 bp, Homo sapiens
cccgcgctcgggctcccggc

SEQ ID NO: 84508 - DNA, 18 bp, Homo sapiens
tccggggattcccccgcc

SEQ ID NO: 84509 - DNA, 19 bp, Homo sapiens
cccgccccagctcctcgcc

SEQ ID NO: 84510 - DNA, 24 bp, Homo sapiens
cccgcgctccaccctctccccgcc

SEQ ID NO: 84511 - DNA, 20 bp, Homo sapiens
tcagcgtcccctcccccgcc

SEQ ID NO: 84512 - DNA, 18 bp, Homo sapiens
ccctgctccacccccgcc

SEQ ID NO: 84513 - DNA, 18 bp, Homo sapiens
ccgcgctcacctcccgcc

SEQ ID NO: 84514 - DNA, 18 bp, Homo sapiens
tccgcgctgggccgcagc

SEQ ID NO: 84515 - DNA, 19 bp, Homo sapiens
cgcgctcgctgcctccgcc

SEQ ID NO: 84516 - DNA, 18 bp, Homo sapiens
ccgcgctccgaccctgcc

SEQ ID NO: 84517 - DNA, 17 bp, Homo sapiens
ccgcgctccgctccgcc

SEQ ID NO: 84518 - DNA, 18 bp, Homo sapiens
ccgcgctcgggctccgcc

SEQ ID NO: 84519 - DNA, 21 bp, Homo sapiens
cccgcgctgtgcgccttcgcc

SEQ ID NO: 84520 - DNA, 23 bp, Homo sapiens
tccgcgccgtcggagccctccgc

SEQ ID NO: 84521 - DNA, 17 bp, Homo sapiens
tccgcgccggctcccgc

SEQ ID NO: 84522 - DNA, 18 bp, Homo sapiens
tctgcgcggacccccgcc

SEQ ID NO: 84523 - DNA, 20 bp, Homo sapiens
ccgcgccccctcctcccgcc

SEQ ID NO: 84524 - DNA, 15 bp, Homo sapiens
cccgctgccccccgc

SEQ ID NO: 84525 - DNA, 19 bp, Homo sapiens
cccgcgctcggtactcgcc

SEQ ID NO: 84526 - DNA, 15 bp, Homo sapiens
cccgcgctcgcccgc

SEQ ID NO: 84527 - DNA, 16 bp, Homo sapiens
tccggcccgcccccgc

SEQ ID NO: 84528 - DNA, 18 bp, Homo sapiens
cccggcgcctcccccgcc

SEQ ID NO: 84529 - DNA, 16 bp, Homo sapiens
cccgcgctcgccccgc

SEQ ID NO: 84530 - DNA, 18 bp, Homo sapiens
gcgcgtcctgcccccgcc

SEQ ID NO: 84531 - DNA, 20 bp, Homo sapiens
tccgcgccgagcagcccgcc

SEQ ID NO: 84532 - DNA, 20 bp, Homo sapiens
ccgcggcgcatccccccgcc

SEQ ID NO: 84533 - DNA, 23 bp, Homo sapiens
tccgcgctgcagttagccccgcc

SEQ ID NO: 84534 - DNA, 15 bp, Homo sapiens
tccggctccccccgc

SEQ ID NO: 84535 - DNA, 19 bp, Homo sapiens
tccgcgctcggcccggcgc

SEQ ID NO: 84536 - DNA, 20 bp, Homo sapiens
ccctcgctgggctccctgcc

SEQ ID NO: 84537 - DNA, 19 bp, Homo sapiens
tcctcccccgcctcccgcc

SEQ ID NO: 84538 - DNA, 22 bp, Homo sapiens
tccgcccccgccgttccccgcc

SEQ ID NO: 84539 - DNA, 20 bp, Homo sapiens
tcggcgctgctccccccgcc

SEQ ID NO: 84540 - DNA, 21 bp, Homo sapiens
tcagcgctcacatcccccgcc

SEQ ID NO: 84541 - DNA, 17 bp, Homo sapiens
tcctgctcggaccccgc

SEQ ID NO: 84542 - DNA, 15 bp, Homo sapiens
tccgcgcccgcccgc

SEQ ID NO: 84543 - DNA, 16 bp, Homo sapiens
cccgcgtctcccccgc

SEQ ID NO: 84544 - DNA, 19 bp, Homo sapiens
cccgcgctgggctcctgcc

SEQ ID NO: 84545 - DNA, 18 bp, Homo sapiens
ccgcgccccgctcctcgc

SEQ ID NO: 84546 - DNA, 20 bp, Homo sapiens
tcccgctcgctcggctccgc

SEQ ID NO: 84547 - DNA, 17 bp, Homo sapiens
cccgcctcgcccccgcc

SEQ ID NO: 84548 - DNA, 20 bp, Homo sapiens
actctggcgggctccctgcc

SEQ ID NO: 84549 - DNA, 18 bp, Homo sapiens
cccgcggacccctctgcc

SEQ ID NO: 84550 - DNA, 18 bp, Homo sapiens
cccgcgcccgcccctgcc

SEQ ID NO: 84551 - DNA, 19 bp, Homo sapiens
cccgcgctcaggcctcccc

SEQ ID NO: 84552 - DNA, 17 bp, Homo sapiens
ccgcgtcgccccccgcc

SEQ ID NO: 84553 - DNA, 20 bp, Homo sapiens
tccccgccgccgcccccgcc

SEQ ID NO: 84554 - DNA, 18 bp, Homo sapiens
tccgcgcccgcctctcgc

SEQ ID NO: 84555 - DNA, 18 bp, Homo sapiens
tccacactgccccccgcc

SEQ ID NO: 84556 - DNA, 23 bp, Homo sapiens
tccacgctcgcagcctcctcgcc

SEQ ID NO: 84557 - DNA, 20 bp, Homo sapiens
tccggggagaatcccccgcc

SEQ ID NO: 84558 - DNA, 21 bp, Homo sapiens
tcctgccccatgccccccgcc

SEQ ID NO: 84559 - DNA, 19 bp, Homo sapiens
tccgcgcccgggcacaggc

SEQ ID NO: 84560 - DNA, 17 bp, Homo sapiens
tctgcgcctcccccgcc

SEQ ID NO: 84561 - DNA, 20 bp, Homo sapiens
tcccgctcaggccccctgcc

SEQ ID NO: 84562 - DNA, 18 bp, Homo sapiens
tcagcaaagccccctgcc

SEQ ID NO: 84563 - DNA, 19 bp, Homo sapiens
cgccgctggcgcccccgcc

SEQ ID NO: 84564 - DNA, 17 bp, Homo sapiens
cacgctcgccctccgcc

SEQ ID NO: 84565 - DNA, 18 bp, Homo sapiens
tccgcacctgccttccgc

SEQ ID NO: 84566 - DNA, 20 bp, Homo sapiens
tcctgcccactccccccgcc

SEQ ID NO: 84567 - DNA, 18 bp, Homo sapiens
gcggacaggccccctgcc

SEQ ID NO: 84568 - DNA, 22 bp, Homo sapiens
ccgcgctccagcactcttcgcc

SEQ ID NO: 84569 - DNA, 17 bp, Homo sapiens
tccagaagccccctgcc

SEQ ID NO: 84570 - DNA, 19 bp, Homo sapiens
cccgcgctcgccgcctgcc

SEQ ID NO: 84571 - DNA, 17 bp, Homo sapiens
ccgcaccgtcccccgcc

SEQ ID NO: 84572 - DNA, 19 bp, Homo sapiens
ccgcgctcaccgacccgcc

SEQ ID NO: 84573 - DNA, 19 bp, Homo sapiens
tccgggctcgggctccggc

SEQ ID NO: 84574 - DNA, 21 bp, Homo sapiens
ccgcgccggctgccccccgcc

SEQ ID NO: 84575 - DNA, 17 bp, Homo sapiens
cccgcgcctcccctcgc

SEQ ID NO: 84576 - DNA, 20 bp, Homo sapiens
tcacgggcccgccccccgcc

SEQ ID NO: 84577 - DNA, 20 bp, Homo sapiens
ccgcgccgccaccccccgcc

SEQ ID NO: 84578 - DNA, 22 bp, Homo sapiens
cccgcgcccggggtcctccgcc

SEQ ID NO: 84579 - DNA, 19 bp, Homo sapiens
cccgcgcccgcctcccgcc

SEQ ID NO: 84580 - DNA, 20 bp, Homo sapiens
cccgcggctcctcctccgcc

SEQ ID NO: 84581 - DNA, 21 bp, Homo sapiens
tccgccccgcctccccccgcc

SEQ ID NO: 84582 - DNA, 22 bp, Homo sapiens
cccgcgcccacctccctccgcc

SEQ ID NO: 84583 - DNA, 22 bp, Homo sapiens
ccgcgcccggccgccccttgcc

SEQ ID NO: 84584 - DNA, 19 bp, Homo sapiens
tccgggccccgcccctgcc

SEQ ID NO: 84585 - DNA, 15 bp, Homo sapiens
tccgcgccccccacc

SEQ ID NO: 84586 - DNA, 19 bp, Homo sapiens
tccgcaccagccccccgcc

SEQ ID NO: 84587 - DNA, 16 bp, Homo sapiens
cccgcgtcgccctcgc

SEQ ID NO: 84588 - DNA, 20 bp, Homo sapiens
cccgcgccgcctcctctgcc

SEQ ID NO: 84589 - DNA, 17 bp, Homo sapiens
tccgcgctcggccgggc

SEQ ID NO: 84590 - DNA, 15 bp, Homo sapiens
tcccgcggcccccgc

SEQ ID NO: 84591 - DNA, 18 bp, Homo sapiens
tccgccgcgtcccccgcc

SEQ ID NO: 84592 - DNA, 18 bp, Homo sapiens
tccacgccctgctcctgc

SEQ ID NO: 84593 - DNA, 19 bp, Homo sapiens
tccacgctgctgctcccgc

SEQ ID NO: 84594 - DNA, 17 bp, Homo sapiens
cccgcgctgctcctcgc

SEQ ID NO: 84595 - DNA, 20 bp, Homo sapiens
cccgcgctcgggttttccgc

SEQ ID NO: 84596 - DNA, 19 bp, Homo sapiens
tccgcgccttgctcctgcc

SEQ ID NO: 84597 - DNA, 21 bp, Homo sapiens
ccgcgctctcgcggctccgcc

SEQ ID NO: 84598 - DNA, 90 bp, Equine herpesvirus 4
gggttgtaagttttaatcagtaggtgtacccaaaaaggccaagagtgcggatctcctgggtgtcaggatttttatagagacttacaagcc

SEQ ID NO: 84599 - DNA, 24 bp, Equine herpesvirus 4
tcctgggtgtcaggatttttatag

SEQ ID NO: 84600 - DNA, 27 bp, Homo sapiens
tcctggatgttaggggtatgattatag

SEQ ID NO: 84601 - DNA, 18 bp, Homo sapiens
cttggtgtcaggatttct

SEQ ID NO: 84602 - DNA, 18 bp, Homo sapiens
tcttgggtgtggcttttt

SEQ ID NO: 84603 - DNA, 18 bp, Homo sapiens
agtgagaaggatttttat

SEQ ID NO: 84604 - DNA, 15 bp, Homo sapiens
tgggtggtttttata

SEQ ID NO: 84605 - DNA, 18 bp, Homo sapiens
tcagggtgtcagattata

SEQ ID NO: 84606 - DNA, 24 bp, Homo sapiens
tcctgggtgtgactgtatttatag

SEQ ID NO: 84607 - DNA, 15 bp, Homo sapiens
tggcaagatttttat

SEQ ID NO: 84608 - DNA, 19 bp, Homo sapiens
tcagggtgttcacttttat

SEQ ID NO: 84609 - DNA, 19 bp, Homo sapiens
tgggtaacaatttttatag

SEQ ID NO: 84610 - DNA, 20 bp, Homo sapiens
tcctggttgcccatttttat

SEQ ID NO: 84611 - DNA, 22 bp, Homo sapiens
tcctgggtttaggagacaatag

SEQ ID NO: 84612 - DNA, 66 bp, Fowl adenovirus D
cttttggcccctctgggtcgcgaggaagtggcggacgccttaagctcgtgccggacgggccgacgg

SEQ ID NO: 84613 - DNA, 24 bp, Fowl adenovirus D
cctctgggtcgcgaggaagtggcg

SEQ ID NO: 84614 - DNA, 17 bp, Homo sapiens
cctcctggggaggtggc

SEQ ID NO: 84615 - DNA, 17 bp, Homo sapiens
cctctgggtggctgtgg

SEQ ID NO: 84616 - DNA, 20 bp, Homo sapiens
cctctgggcgtgggtccgtg

SEQ ID NO: 84617 - DNA, 18 bp, Homo sapiens
ccctggatgagggggtgg

SEQ ID NO: 84618 - DNA, 18 bp, Homo sapiens
cctctgggtctggggaag

SEQ ID NO: 84619 - DNA, 22 bp, Homo sapiens
cctcattcatgtgaggaagtgg

SEQ ID NO: 84620 - DNA, 21 bp, Homo sapiens
cctctgggctgtgagtctgtg

SEQ ID NO: 84621 - DNA, 16 bp, Homo sapiens
ccctgggttgcagtgg

SEQ ID NO: 84622 - DNA, 20 bp, Homo sapiens
ctctgggttggtgaggggcg

SEQ ID NO: 84623 - DNA, 21 bp, Homo sapiens
cctttgcggtcgcggcgggtg

SEQ ID NO: 84624 - DNA, 16 bp, Homo sapiens
ctctgggtagcggtgg

SEQ ID NO: 84625 - DNA, 21 bp, Homo sapiens
cctccgggtcgcccagggtgg

SEQ ID NO: 84626 - DNA, 19 bp, Homo sapiens
cctctggctggaggagtgg

SEQ ID NO: 84627 - DNA, 19 bp, Homo sapiens
tctgggtcgcgggtgggcg

SEQ ID NO: 84628 - DNA, 18 bp, Homo sapiens
cctgctggcaggaagtgg

SEQ ID NO: 84629 - DNA, 17 bp, Homo sapiens
ctgggtcaaaggtggtg

SEQ ID NO: 84630 - DNA, 17 bp, Homo sapiens
tctggctctggaagtgg

SEQ ID NO: 84631 - DNA, 19 bp, Homo sapiens
cctctgggttccgagggtg

SEQ ID NO: 84632 - DNA, 22 bp, Homo sapiens
cccctggcgggaggaagtggcg

SEQ ID NO: 84633 - DNA, 19 bp, Homo sapiens
ctttgggaggcggaagtgg

SEQ ID NO: 84634 - DNA, 18 bp, Homo sapiens
ctctgggttcgagggaag

SEQ ID NO: 84635 - DNA, 19 bp, Homo sapiens
tctggatcctcaggtggtg

SEQ ID NO: 84636 - DNA, 24 bp, Homo sapiens
ctactgagagttgaggaagtggcg

SEQ ID NO: 84637 - DNA, 22 bp, Homo sapiens
gggccctcgtggggaggtggcg

SEQ ID NO: 84638 - DNA, 20 bp, Homo sapiens
ccctgggttccgaggtggtg

SEQ ID NO: 84639 - DNA, 85 bp, Myxoma virus
ggaaacgcgccagactccggaactatgaaggatttatcactgtatacagactccgacgtacgaaggataatcacgacgtaactcc

SEQ ID NO: 84640 - DNA, 24 bp, Myxoma virus
tgaaggatttatcactgtatacag

SEQ ID NO: 84641 - DNA, 27 bp, Homo sapiens
aaggatttgtcatgatggctgtataca

SEQ ID NO: 84642 - DNA, 17 bp, Homo sapiens
tgaagatttattgctgt

SEQ ID NO: 84643 - DNA, 17 bp, Homo sapiens
tgcaggacaactgtata

SEQ ID NO: 84644 - DNA, 25 bp, Homo sapiens
tgatggatttatcaacagctgtatc

SEQ ID NO: 84645 - DNA, 20 bp, Homo sapiens
taaaggatttgttcatatat

SEQ ID NO: 84646 - DNA, 29 bp, Homo sapiens
tgaaggatttgacgtttgagctgtataca

SEQ ID NO: 84647 - DNA, 28 bp, Homo sapiens
tgaaggatttaccattaagctgtataca

SEQ ID NO: 84648 - DNA, 20 bp, Homo sapiens
tgaagatgcaccactgtata

SEQ ID NO: 84649 - DNA, 16 bp, Homo sapiens
taaaggatctgtgtac

SEQ ID NO: 84650 - DNA, 21 bp, Homo sapiens
aaggatttatcacaaagtata

SEQ ID NO: 84651 - DNA, 17 bp, Homo sapiens
gagggatttattgtata

SEQ ID NO: 84652 - DNA, 19 bp, Homo sapiens
tgaagaatttatcacacac

SEQ ID NO: 84653 - DNA, 20 bp, Homo sapiens
gaaggatttattgcgcccag

SEQ ID NO: 84654 - DNA, 110 bp, Bovine herpesvirus 1
gcttaagtacgggccgcggcgatcgcgggcgtcgatcgcgtgcggcttggagtccggctgccgtttctgccgcaagcgcgatcccgcgacacgacccgacgttcttgggc

SEQ ID NO: 84655 - DNA, 24 bp, Bovine herpesvirus 1
ctgccgcaagcgcgatcccgcgac

SEQ ID NO: 84656 - DNA, 21 bp, Homo sapiens
ctgccgcagaggcggcccgcg

SEQ ID NO: 84657 - DNA, 20 bp, Homo sapiens
tgcctcagggcgccccgcga

SEQ ID NO: 84658 - DNA, 21 bp, Homo sapiens
tgctggggcccggcccgcgac

SEQ ID NO: 84659 - DNA, 21 bp, Homo sapiens
cctgcaggcccggcccgcgac

SEQ ID NO: 84660 - DNA, 19 bp, Homo sapiens
ctgccaacgggtcccgcga

SEQ ID NO: 84661 - DNA, 16 bp, Homo sapiens
ctgccggcgtcccgcg

SEQ ID NO: 84662 - DNA, 19 bp, Homo sapiens
ctgccgcaagtgcaaaggc

SEQ ID NO: 84663 - DNA, 15 bp, Homo sapiens
gccgcaaatcccgcg

SEQ ID NO: 84664 - DNA, 24 bp, Homo sapiens
ctgccgcaggcgcgtccagaacga

SEQ ID NO: 84665 - DNA, 22 bp, Homo sapiens
ctgccggcgagtcacccgcgac

SEQ ID NO: 84666 - DNA, 26 bp, Homo sapiens
ctgccgcaggtgggagcgcgcgtggc

SEQ ID NO: 84667 - DNA, 70 bp, Bovine herpesvirus 1
ggcgacggccgcgcttacgcggcgctgggtccgcccacatcagccaccacgcccgcgcgcccgccccgcc

SEQ ID NO: 84668 - DNA, 24 bp, Bovine herpesvirus 1
tcagccaccacgcccgcgcgcccg

SEQ ID NO: 84669 - DNA, 24 bp, Homo sapiens
tcggccgcgcgccaccggcgcccg

SEQ ID NO: 84670 - DNA, 18 bp, Homo sapiens
tcagccacctgcccctcc

SEQ ID NO: 84671 - DNA, 17 bp, Homo sapiens
agccaccatgcccggca

SEQ ID NO: 84672 - DNA, 20 bp, Homo sapiens
agcgctggcccgcgcgctcg

SEQ ID NO: 84673 - DNA, 22 bp, Homo sapiens
tcggctgttgcgtccgcacgcc

SEQ ID NO: 84674 - DNA, 17 bp, Homo sapiens
tcggccaccacccctcg

SEQ ID NO: 84675 - DNA, 21 bp, Homo sapiens
tcagctgcgacgcccgcgccc

SEQ ID NO: 84676 - DNA, 19 bp, Homo sapiens
tcagccactgggccgcccc

SEQ ID NO: 84677 - DNA, 16 bp, Homo sapiens
cagccgccacccgcgc

SEQ ID NO: 84678 - DNA, 18 bp, Homo sapiens
tcggccgcccgcgccccc

SEQ ID NO: 84679 - DNA, 16 bp, Homo sapiens
tcggccgccgcgcacc

SEQ ID NO: 84680 - DNA, 18 bp, Homo sapiens
agtcaccgcgcccggccc

SEQ ID NO: 84681 - DNA, 22 bp, Homo sapiens
tcagccacacgccctgactccg

SEQ ID NO: 84682 - DNA, 22 bp, Homo sapiens
tcggccgcccccgccgcgcccg

SEQ ID NO: 84683 - DNA, 18 bp, Homo sapiens
agccaccgcgcccagccc

SEQ ID NO: 84684 - DNA, 22 bp, Homo sapiens
tcagctgacacagccgcgcccg

SEQ ID NO: 84685 - DNA, 17 bp, Homo sapiens
agccaccacgcctggcc

SEQ ID NO: 84686 - DNA, 24 bp, Homo sapiens
tcagccccgcgcccgcagggcccg

SEQ ID NO: 84687 - DNA, 21 bp, Homo sapiens
gccgccgcaacgccgcgcccg

SEQ ID NO: 84688 - DNA, 21 bp, Homo sapiens
agccaccacgcccggccaccg

SEQ ID NO: 84689 - DNA, 20 bp, Homo sapiens
agccaccgcgcccgaccacc

SEQ ID NO: 84690 - DNA, 22 bp, Homo sapiens
gccccgcgcgcccgcgcgcccg

SEQ ID NO: 84691 - DNA, 17 bp, Homo sapiens
agccaccgcgcccagcc

SEQ ID NO: 84692 - DNA, 18 bp, Homo sapiens
gccaccacgctggctccg

SEQ ID NO: 84693 - DNA, 18 bp, Homo sapiens
tcggccgcccgcgccgcc

SEQ ID NO: 84694 - DNA, 22 bp, Homo sapiens
tcagccaccacctgtgcggcgc

SEQ ID NO: 84695 - DNA, 18 bp, Homo sapiens
agccaccgcgcccggccc

SEQ ID NO: 84696 - DNA, 17 bp, Homo sapiens
agccaccgcgcccggcc

SEQ ID NO: 84697 - DNA, 18 bp, Homo sapiens
ccagctgctccgcgcgcc

SEQ ID NO: 84698 - DNA, 17 bp, Homo sapiens
agccaccacgcccggcg

SEQ ID NO: 84699 - DNA, 16 bp, Homo sapiens
tcagcagccacgcgcc

SEQ ID NO: 84700 - DNA, 17 bp, Homo sapiens
agccaccacgcccagcc

SEQ ID NO: 84701 - DNA, 18 bp, Homo sapiens
cagccaccgcggacgccc

SEQ ID NO: 84702 - DNA, 19 bp, Homo sapiens
agccaccatgcccggccca

SEQ ID NO: 84703 - DNA, 17 bp, Homo sapiens
tcagacttccgcgcgcc

SEQ ID NO: 84704 - DNA, 21 bp, Homo sapiens
gccgccgccgccgcgcgcccg

SEQ ID NO: 84705 - DNA, 17 bp, Homo sapiens
tcagccacccgccaccc

SEQ ID NO: 84706 - DNA, 21 bp, Homo sapiens
agccaccgcgcccggccttcc

SEQ ID NO: 84707 - DNA, 20 bp, Homo sapiens
tcagccaccaggtcctccac

SEQ ID NO: 84708 - DNA, 17 bp, Homo sapiens
agccaccatgcccggcc

SEQ ID NO: 84709 - DNA, 20 bp, Homo sapiens
agccaccatgcccggcctcc

SEQ ID NO: 84710 - DNA, 16 bp, Homo sapiens
gccaccacaggcgccc

SEQ ID NO: 84711 - DNA, 19 bp, Homo sapiens
agccatcacgcccggccca

SEQ ID NO: 84712 - DNA, 17 bp, Homo sapiens
agccaccatgcctgccc

SEQ ID NO: 84713 - DNA, 19 bp, Homo sapiens
agccaccgcgcccggccca

SEQ ID NO: 84714 - DNA, 17 bp, Homo sapiens
agccaccacgctcaccc

SEQ ID NO: 84715 - DNA, 19 bp, Homo sapiens
tcagccaccatgcccggac

SEQ ID NO: 84716 - DNA, 18 bp, Homo sapiens
gccggcaccgcgcgctcg

SEQ ID NO: 84717 - DNA, 18 bp, Homo sapiens
cagccgccactcgcgccc

SEQ ID NO: 84718 - DNA, 20 bp, Homo sapiens
agccaccacgcctggccagc

SEQ ID NO: 84719 - DNA, 17 bp, Homo sapiens
agccaccacgtccagcc

SEQ ID NO: 84720 - DNA, 18 bp, Homo sapiens
tcggccgcccgcgcccca

SEQ ID NO: 84721 - DNA, 17 bp, Homo sapiens
agctaccacgcccggcc

SEQ ID NO: 84722 - DNA, 18 bp, Homo sapiens
cagccgccgcgcccaccg

SEQ ID NO: 84723 - DNA, 18 bp, Homo sapiens
gccaccacggcactgccc

SEQ ID NO: 84724 - DNA, 17 bp, Homo sapiens
cagctccccgcgcgccc

SEQ ID NO: 84725 - DNA, 17 bp, Homo sapiens
agccaccacgcccggcc

SEQ ID NO: 84726 - DNA, 21 bp, Homo sapiens
tcagccaccacgtcctccccc

SEQ ID NO: 84727 - DNA, 20 bp, Homo sapiens
agccaccacgcccggccacg

SEQ ID NO: 84728 - DNA, 24 bp, Homo sapiens
agccgagtcgcgcccgcgcgcccg

SEQ ID NO: 84729 - DNA, 20 bp, Homo sapiens
ccgccgccgcctcgcgcccg

SEQ ID NO: 84730 - DNA, 18 bp, Homo sapiens
tcagccactgcccgttcc

SEQ ID NO: 84731 - DNA, 16 bp, Homo sapiens
cagccgccaccgcgcc

SEQ ID NO: 84732 - DNA, 19 bp, Homo sapiens
agccaccgcgcccggcccg

SEQ ID NO: 84733 - DNA, 23 bp, Homo sapiens
tcagccgcccacgcctctgctcg

SEQ ID NO: 84734 - DNA, 25 bp, Homo sapiens
tcggccgcccgcgtccccaggcccg

SEQ ID NO: 84735 - DNA, 18 bp, Homo sapiens
agccaccatgcctggccc

SEQ ID NO: 84736 - DNA, 19 bp, Homo sapiens
tcagccccgcgcccgcaca

SEQ ID NO: 84737 - DNA, 20 bp, Homo sapiens
agtcaccgcgcccagctccg

SEQ ID NO: 84738 - DNA, 16 bp, Homo sapiens
tcggcaccgcccgcgc

SEQ ID NO: 84739 - DNA, 25 bp, Homo sapiens
tcagccactgtgcactgccagagcc

SEQ ID NO: 84740 - DNA, 21 bp, Homo sapiens
agtcaccacgcctggcctccg

SEQ ID NO: 84741 - DNA, 19 bp, Homo sapiens
agccaccgcgcccggcacc

SEQ ID NO: 84742 - DNA, 25 bp, Homo sapiens
tcagccacgcacgtgtaggtgcccg

SEQ ID NO: 84743 - DNA, 18 bp, Homo sapiens
ccagccaccatgcccggc

SEQ ID NO: 84744 - DNA, 19 bp, Homo sapiens
agccaccatgcctggccca

SEQ ID NO: 84745 - DNA, 18 bp, Homo sapiens
tcagccaccgcgcctggc

SEQ ID NO: 84746 - DNA, 89 bp, Okra enation virus
ttggtcaatcggtactcagatgcttctctccaatatatcggtactcaatatatagtgagtaccaaatggcattttggtaaaaatcccaa

SEQ ID NO: 84747 - DNA, 24 bp, Okra enation virus
tcagatgcttctctccaatatatc

SEQ ID NO: 84748 - DNA, 17 bp, Homo sapiens
tcagaagcacccaatat

SEQ ID NO: 84749 - DNA, 17 bp, Homo sapiens
gaagcctccaatgtatc

SEQ ID NO: 84750 - DNA, 17 bp, Homo sapiens
tcagatgcttcttccaa

SEQ ID NO: 84751 - DNA, 20 bp, Homo sapiens
tcaacttttttctccaatat

SEQ ID NO: 84752 - DNA, 16 bp, Homo sapiens
aatgctctcaatatat

SEQ ID NO: 84753 - DNA, 22 bp, Homo sapiens
tcatatgcttcttcaattatat

SEQ ID NO: 84754 - DNA, 20 bp, Homo sapiens
gatgccatttctaatatatc

SEQ ID NO: 84755 - DNA, 23 bp, Homo sapiens
tcagatactttttggtttatatc

SEQ ID NO: 84756 - DNA, 18 bp, Homo sapiens
tcaggtgcttctcttacc

SEQ ID NO: 84757 - DNA, 18 bp, Homo sapiens
cagatgcttttctcaaac

SEQ ID NO: 84758 - DNA, 18 bp, Homo sapiens
cagatgcttttctcaaat

SEQ ID NO: 84759 - DNA, 116 bp, Paramecium bursaria Chlorella virus 1
tcgttttttttaacccagttttacgtataatatgataacatttgttgatataatgaaatgacgtatatacaaacttatatcaatgcttattgtataaatggttaaatatacaatga

SEQ ID NO: 84760 - DNA, 22 bp, Paramecium bursaria Chlorella virus 1
taaatggttaaatatacaatga

SEQ ID NO: 84761 - DNA, 19 bp, Homo sapiens
taagtggttaacatacaca

SEQ ID NO: 84762 - DNA, 17 bp, Homo sapiens
aaatggttatgacaatg

SEQ ID NO: 84763 - DNA, 17 bp, Homo sapiens
aaatggttaagtacaat

SEQ ID NO: 84764 - DNA, 19 bp, Homo sapiens
ggttaaataaaacaagtga

SEQ ID NO: 84765 - DNA, 21 bp, Homo sapiens
taaatagttaaatatatttga

SEQ ID NO: 84766 - DNA, 20 bp, Homo sapiens
atggaagaaaatatacaatg

SEQ ID NO: 84767 - DNA, 18 bp, Homo sapiens
tggttaacatacaaatga

SEQ ID NO: 84768 - DNA, 21 bp, Homo sapiens
taaatggttaatgtgcaatga

SEQ ID NO: 84769 - DNA, 19 bp, Homo sapiens
atggccaaatatacgatga

SEQ ID NO: 84770 - DNA, 19 bp, Homo sapiens
atgtgttaaatgtacaatg

SEQ ID NO: 84771 - DNA, 23 bp, Homo sapiens
tgatggttaaacatattataatg

SEQ ID NO: 84772 - DNA, 24 bp, Homo sapiens
taaatagtcacatatatacaatga

SEQ ID NO: 84773 - DNA, 21 bp, Homo sapiens
tgatggaccgcatatacaatg

SEQ ID NO: 84774 - DNA, 17 bp, Homo sapiens
taaaggtacatacaatg

SEQ ID NO: 84775 - DNA, 23 bp, Homo sapiens
caaatggtttcatggtacaatga

SEQ ID NO: 84776 - DNA, 20 bp, Homo sapiens
aaatggttatttcaacaatg

SEQ ID NO: 84777 - DNA, 67 bp, Wheat streak mosaic virus
tctgacaacgaacaaaacgaactcaaagcacccacaagctctagttcaacaaagttcatcacgcaga

SEQ ID NO: 84778 - DNA, 24 bp, Wheat streak mosaic virus
acgaacaaaacgaactcaaagcac

SEQ ID NO: 84779 - DNA, 22 bp, Homo sapiens
gaacaggactccagcaaagcac

SEQ ID NO: 84780 - DNA, 20 bp, Homo sapiens
cgaacaaaaccggctctagc

SEQ ID NO: 84781 - DNA, 17 bp, Homo sapiens
cgaacaaaacaaagcgc

SEQ ID NO: 84782 - DNA, 23 bp, Homo sapiens
gaacaaaaacggaaaaaaaagca

SEQ ID NO: 84783 - DNA, 18 bp, Homo sapiens
acgagaaccttcaaagca

SEQ ID NO: 84784 - DNA, 19 bp, Homo sapiens
aacaggtgagtcaaagcac

SEQ ID NO: 84785 - DNA, 17 bp, Homo sapiens
gaacaaaagacacaaag

SEQ ID NO: 84786 - DNA, 24 bp, Homo sapiens
gaacaaaattaacaaaaaaaagca

SEQ ID NO: 84787 - DNA, 21 bp, Homo sapiens
accggacgggcctcaaagcac

SEQ ID NO: 84788 - DNA, 22 bp, Homo sapiens
cgaacaaaaatccccaaagcac

SEQ ID NO: 84789 - DNA, 18 bp, Homo sapiens
caaacaaaaaataaagca

SEQ ID NO: 84790 - DNA, 23 bp, Homo sapiens
acaaacaaagtcccgcggagcac

SEQ ID NO: 84791 - DNA, 21 bp, Homo sapiens
acagacaaggaatcaaagcac

SEQ ID NO: 84792 - DNA, 18 bp, Homo sapiens
gacaaaactctcaaagca

SEQ ID NO: 84793 - DNA, 22 bp, Homo sapiens
gaaaagaacatatacaaagcac

SEQ ID NO: 84794 - DNA, 24 bp, Homo sapiens
acaaataagacatttacaaagcac

SEQ ID NO: 84795 - DNA, 18 bp, Homo sapiens
acaaacaaaacgacagca

SEQ ID NO: 84796 - DNA, 20 bp, Homo sapiens
cgaacagggtctcaaagcac

SEQ ID NO: 84797 - DNA, 21 bp, Homo sapiens
acgaacaaaacagaacttcaa

SEQ ID NO: 84798 - DNA, 22 bp, Homo sapiens
gaacaaaacatcattttcaaag

SEQ ID NO: 84799 - DNA, 17 bp, Homo sapiens
aacaaaacacaaaagca

SEQ ID NO: 84800 - DNA, 26 bp, Homo sapiens
aaacaaaatacatacactcaaggcac

SEQ ID NO: 84801 - DNA, 17 bp, Homo sapiens
gaaaaaatgaactcaaa

SEQ ID NO: 84802 - DNA, 22 bp, Homo sapiens
gaacgaggagaggctcaaagca

SEQ ID NO: 84803 - DNA, 22 bp, Homo sapiens
gaacaaaacatctctagagcac

SEQ ID NO: 84804 - DNA, 26 bp, Homo sapiens
gaacaaactgatagggtttaaagcac

SEQ ID NO: 84805 - DNA, 81 bp, Sendai virus
ggtctgtacataataagaaaaacttagggtgaaagttaggttgctcaccactatagctttcacctcaagtaagtacagatc

SEQ ID NO: 84806 - DNA, 24 bp, Sendai virus
tagctttcacctcaagtaagtaca

SEQ ID NO: 84807 - DNA, 19 bp, Homo sapiens
actttaaaaagtaagtaca

SEQ ID NO: 84808 - DNA, 21 bp, Homo sapiens
tagctttcctcttttaaagta

SEQ ID NO: 84809 - DNA, 17 bp, Homo sapiens
tagccttcatcaaagta

SEQ ID NO: 84810 - DNA, 21 bp, Homo sapiens
tagctttcaattcaaattagt

SEQ ID NO: 84811 - DNA, 19 bp, Homo sapiens
tagctttccttcaatggta

SEQ ID NO: 84812 - DNA, 20 bp, Homo sapiens
gcttttcacttaaaataagt

SEQ ID NO: 84813 - DNA, 18 bp, Homo sapiens
gcttttacctcaagaaat

SEQ ID NO: 84814 - DNA, 21 bp, Homo sapiens
gcctttcggagagtaagtaca

SEQ ID NO: 84815 - DNA, 22 bp, Homo sapiens
tagctttcacctctgatagaca

SEQ ID NO: 84816 - DNA, 19 bp, Homo sapiens
gctttcaccacagagagca

SEQ ID NO: 84817 - DNA, 22 bp, Homo sapiens
tagcttccacccatgggtaggt

SEQ ID NO: 84818 - DNA, 18 bp, Homo sapiens
taactttcaccttaggca

SEQ ID NO: 84819 - DNA, 21 bp, Homo sapiens
tagctttcatctagtccagca

SEQ ID NO: 84820 - DNA, 24 bp, Homo sapiens
tagctttctcctcagaaacttaca

SEQ ID NO: 84821 - DNA, 16 bp, Homo sapiens
tagctttcactctgta

SEQ ID NO: 84822 - DNA, 19 bp, Homo sapiens
tagctttgtctagcaagta

SEQ ID NO: 84823 - DNA, 17 bp, Homo sapiens
gcttcaccttggtaaac

SEQ ID NO: 84824 - DNA, 19 bp, Homo sapiens
tagctttcgcccagtagac

SEQ ID NO: 84825 - DNA, 114 bp, Fowl adenovirus D
gagagaaaagaaaaaaaccgcgggtgccggtgctgtctaaaaggccgttttcaataaaaatttttatagaaccgctgtcgccgccgtcgtttgccgtttgtcgtcgtcgtcgtc

SEQ ID NO: 84826 - DNA, 24 bp, Fowl adenovirus D
atagaaccgctgtcgccgccgtcg

SEQ ID NO: 84827 - DNA, 20 bp, Homo sapiens
acaggaccgctgtccctcgt

SEQ ID NO: 84828 - DNA, 18 bp, Homo sapiens
tagaactgctgtcacacg

SEQ ID NO: 84829 - DNA, 17 bp, Homo sapiens
gaatccgtgccgccgtc

SEQ ID NO: 84830 - DNA, 19 bp, Homo sapiens
gctgtcgcagctgccgtcg

SEQ ID NO: 84831 - DNA, 22 bp, Homo sapiens
ataggggcgcccaccgtcgtcg

SEQ ID NO: 84832 - DNA, 20 bp, Homo sapiens
gaggacggccgccgccgtcg

SEQ ID NO: 84833 - DNA, 21 bp, Homo sapiens
gagtcgtcgtcgtcgccgtcg

SEQ ID NO: 84834 - DNA, 99 bp, Paramecium bursaria Chlorella virus 1
gattagtcatcttgtatgcattttaattaaatatatgtaataaattatacatttttaaacagataatatatatttaaaaatgtttacattaccctaatt

SEQ ID NO: 84835 - DNA, 24 bp, Paramecium bursaria Chlorella virus 1
tcttgtatgcattttaattaaata

SEQ ID NO: 84836 - DNA, 22 bp, Homo sapiens
tcctgtatattttaattaaata

SEQ ID NO: 84837 - DNA, 21 bp, Homo sapiens
tcttgtggcattttaaaaaat

SEQ ID NO: 84838 - DNA, 20 bp, Homo sapiens
tcttgtgctgccaattaaat

SEQ ID NO: 84839 - DNA, 19 bp, Homo sapiens
tcttggtgcattttaatca

SEQ ID NO: 84840 - DNA, 22 bp, Homo sapiens
tcttgtattgcatttttttcaa

SEQ ID NO: 84841 - DNA, 24 bp, Homo sapiens
tcttgttgcattttttaacaaata

SEQ ID NO: 84842 - DNA, 104 bp, Paramecium bursaria Chlorella virus 1
tttgtttatttttatgatgtaacatatattaatgtttacacagagcgcaataacgtcctgtgtaattataaattctcattgacatcatatttttctattacaaa

SEQ ID NO: 84843 - DNA, 24 bp, Paramecium bursaria Chlorella virus 1
tttatgatgtaacatatattaatg

SEQ ID NO: 84844 - DNA, 18 bp, Homo sapiens
tttatgatgtgtatacta

SEQ ID NO: 84845 - DNA, 103 bp, Infectious spleen and kidney necrosis virus
tctagtcaagtgcttttattttgtcatatgctgccacaggtgggctacctcaacccatgaccacagagaccaacaaataaatgaatcgccggcactttaaaga

SEQ ID NO: 84846 - DNA, 24 bp, Infectious spleen and kidney necrosis virus
tgaccacagagaccaacaaataaa

SEQ ID NO: 84847 - DNA, 23 bp, Homo sapiens
tgaacacagagaatcacaaataa

SEQ ID NO: 84848 - DNA, 16 bp, Homo sapiens
tgaccacagaacaaca

SEQ ID NO: 84849 - DNA, 23 bp, Homo sapiens
tggtcacactctcaacaaataaa

SEQ ID NO: 84850 - DNA, 21 bp, Homo sapiens
tggccacaaaggactccagca

SEQ ID NO: 84851 - DNA, 22 bp, Homo sapiens
accacatttcccaacaaataaa

SEQ ID NO: 84852 - DNA, 21 bp, Homo sapiens
tgacacaagcatcaacaaata

SEQ ID NO: 84853 - DNA, 17 bp, Homo sapiens
accacaaaagcaaataa

SEQ ID NO: 84854 - DNA, 19 bp, Homo sapiens
tggccacagagcccagcaa

SEQ ID NO: 84855 - DNA, 20 bp, Homo sapiens
tgaccacagaggtttacaaa

SEQ ID NO: 84856 - DNA, 20 bp, Homo sapiens
cacaaagactcccaaataaa

SEQ ID NO: 84857 - DNA, 22 bp, Homo sapiens
tgagcacgaacactaacaaata

SEQ ID NO: 84858 - DNA, 18 bp, Homo sapiens
actatagaccacaaataa

SEQ ID NO: 84859 - DNA, 18 bp, Homo sapiens
tgcccggccaacaaataa

SEQ ID NO: 84860 - DNA, 22 bp, Homo sapiens
tggccatggagaccaacagaca

SEQ ID NO: 84861 - DNA, 18 bp, Homo sapiens
tgaccacagagctacaaa

SEQ ID NO: 84862 - DNA, 22 bp, Homo sapiens
tggccacaaaaagacaaataaa

SEQ ID NO: 84863 - DNA, 23 bp, Homo sapiens
tgatcattagatcccacaaataa

SEQ ID NO: 84864 - DNA, 20 bp, Homo sapiens
accacagagccctagataaa

SEQ ID NO: 84865 - DNA, 86 bp, Rat cytomegalovirus
cgtcgcctcctggaactcccggatatacctcgccccgtagatcttatatgttacctgggtgggatttccgcgcctcgagcgtgacg

SEQ ID NO: 84866 - DNA, 24 bp, Rat cytomegalovirus
tggaactcccggatatacctcgcc

SEQ ID NO: 84867 - DNA, 21 bp, Homo sapiens
tggcactcccagagctttgcc

SEQ ID NO: 84868 - DNA, 21 bp, Homo sapiens
tggaattctcagagggaacct

SEQ ID NO: 84869 - DNA, 21 bp, Homo sapiens
gggccgccggatatgtcttgc

SEQ ID NO: 84870 - DNA, 20 bp, Homo sapiens
tggaagtccatataccttgc

SEQ ID NO: 84871 - DNA, 15 bp, Homo sapiens
tggaactcatacctg

SEQ ID NO: 84872 - DNA, 22 bp, Homo sapiens
tggaattccactttacctcgcc

SEQ ID NO: 84873 - DNA, 66 bp, Human herpesvirus 4
ggggggcagtgataagtcatgacaattttagatgaggtagaaattttgcatattttcagacccacc

SEQ ID NO: 84874 - DNA, 24 bp, Human herpesvirus 4
taagtcatgacaattttagatgag

SEQ ID NO: 84875 - DNA, 18 bp, Homo sapiens
taagtcatgattatctga

SEQ ID NO: 84876 - DNA, 19 bp, Homo sapiens
agtcataataatttcccga

SEQ ID NO: 84877 - DNA, 19 bp, Homo sapiens
gccatgacatctagatgag

SEQ ID NO: 84878 - DNA, 21 bp, Homo sapiens
caagttgtctttttagatgag

SEQ ID NO: 84879 - DNA, 16 bp, Homo sapiens
taagtcatgaaatatg

SEQ ID NO: 84880 - DNA, 19 bp, Homo sapiens
taagtcattgcaattttaa

SEQ ID NO: 84881 - DNA, 76 bp, African swine fever virus
attccacgttctcataaaaacaggcacttaaaaagagcaccaggtttagtgtagtcttattatagaatgtaggaat

SEQ ID NO: 84882 - DNA, 24 bp, African swine fever virus
tccacgttctcataaaaacaggca

SEQ ID NO: 84883 - DNA, 21 bp, Homo sapiens
cattttctcataaactatgca

SEQ ID NO: 84884 - DNA, 19 bp, Homo sapiens
gttcttattcaaacaggca

SEQ ID NO: 84885 - DNA, 18 bp, Homo sapiens
gttctcatgcgacaggca

SEQ ID NO: 84886 - DNA, 23 bp, Homo sapiens
tcctgttttcccccaaacaggca

SEQ ID NO: 84887 - DNA, 22 bp, Homo sapiens
tccactttggggaaaacaggca

SEQ ID NO: 84888 - DNA, 23 bp, Homo sapiens
cccatgtacacaagaaacaggca

SEQ ID NO: 84889 - DNA, 21 bp, Homo sapiens
tccattgtccagaaacaggca

SEQ ID NO: 84890 - DNA, 16 bp, Homo sapiens
tccatcttaaaacagg

SEQ ID NO: 84891 - DNA, 17 bp, Homo sapiens
tccatgtttaaaacagg

SEQ ID NO: 84892 - DNA, 19 bp, Homo sapiens
cgtcactatagaaacaggc

SEQ ID NO: 84893 - DNA, 19 bp, Homo sapiens
gtttccatatgaacaggca

SEQ ID NO: 84894 - DNA, 20 bp, Homo sapiens
gtatcgattagaaacaggca

SEQ ID NO: 84895 - DNA, 19 bp, Homo sapiens
tccacgtttgtgcataggc

SEQ ID NO: 84896 - DNA, 19 bp, Homo sapiens
tccacgtcttataaaagac

SEQ ID NO: 84897 - DNA, 18 bp, Homo sapiens
gttttcataaaaatggca

SEQ ID NO: 84898 - DNA, 19 bp, Homo sapiens
tctggcaagaaaacaggca

SEQ ID NO: 84899 - DNA, 23 bp, Homo sapiens
caagaccctcataaagacgggca

SEQ ID NO: 84900 - DNA, 92 bp, Chimpanzee cytomegalovirus
cggattatctatgtgcatggagtgtcctacatatcaaaataaatggttttactgaaggatacaattgttcatgttgtttcttggtaaatttg

SEQ ID NO: 84901 - DNA, 24 bp, Chimpanzee cytomegalovirus
tgcatggagtgtcctacatatcaa

SEQ ID NO: 84902 - DNA, 15 bp, Homo sapiens
tgatggatacatatc

SEQ ID NO: 84903 - DNA, 19 bp, Homo sapiens
catggagtgtcccccttca

SEQ ID NO: 84904 - DNA, 19 bp, Homo sapiens
tagagtgcctatgtatcaa

SEQ ID NO: 84905 - DNA, 19 bp, Homo sapiens
tgtatgtgagtgttttaca

SEQ ID NO: 84906 - DNA, 16 bp, Homo sapiens
tgcatgcagacatatc

SEQ ID NO: 84907 - DNA, 21 bp, Homo sapiens
catggaacccctacgtatcaa

SEQ ID NO: 84908 - DNA, 20 bp, Homo sapiens
gagtggcaactacatatcaa

SEQ ID NO: 84909 - DNA, 20 bp, Homo sapiens
tgcagttttcttacatatca

SEQ ID NO: 84910 - DNA, 22 bp, Homo sapiens
tgtgtagagctttacatatcaa

SEQ ID NO: 84911 - DNA, 19 bp, Homo sapiens
caagaattgttctacatat

SEQ ID NO: 84912 - DNA, 19 bp, Homo sapiens
tgcatggagtcgtcttcca

SEQ ID NO: 84913 - DNA, 23 bp, Homo sapiens
tgctttttcatcttacatatcaa

SEQ ID NO: 84914 - DNA, 19 bp, Homo sapiens
tgcaggagtgtcttcacca

SEQ ID NO: 84915 - DNA, 19 bp, Homo sapiens
tgcaaggacctgcatatca

SEQ ID NO: 84916 - DNA, 21 bp, Homo sapiens
gcagaatgtcttatatgtcaa

SEQ ID NO: 84917 - DNA, 70 bp, Theilovirus
tcctctcgatcggatcgcaacgctttaccctagaagccactagggtgtacgcggccgttctgacgttgga

SEQ ID NO: 84918 - DNA, 24 bp, Theilovirus
tctcgatcggatcgcaacgcttta

SEQ ID NO: 84919 - DNA, 23 bp, Homo sapiens
tcaatcgaacagatgatgcttta

SEQ ID NO: 84920 - DNA, 60 bp, Newcastle disease virus
ggtagaaggtgtgaatctcgagtgcgagcccgaagcacaaactcgaggaagccttctgcc

SEQ ID NO: 84921 - DNA, 24 bp, Newcastle disease virus
tagaaggtgtgaatctcgagtgcg

SEQ ID NO: 84922 - DNA, 18 bp, Homo sapiens
agggggacctcgggtgcg

SEQ ID NO: 84923 - DNA, 20 bp, Homo sapiens
taggagtgtgaatctgggtg

SEQ ID NO: 84924 - DNA, 95 bp, Molluscum contagiosum virus
aggcaagattcactctgcaagacgtgtgaagtagcgaacgctcacgcgaagagctattttttcagtttttgttctttctctcgtggatcgctcct

SEQ ID NO: 84925 - DNA, 24 bp, Molluscum contagiosum virus
tgcaagacgtgtgaagtagcgaac

SEQ ID NO: 84926 - DNA, 21 bp, Homo sapiens
tgcagggctgtgaagtgagac

SEQ ID NO: 84927 - DNA, 20 bp, Homo sapiens
aagaccctagaaagtagcga

SEQ ID NO: 84928 - DNA, 22 bp, Homo sapiens
tgcaaggcatgtgaaatgcagc

SEQ ID NO: 84929 - DNA, 18 bp, Homo sapiens
agacgtgtccatggcgaa

SEQ ID NO: 84930 - DNA, 20 bp, Homo sapiens
tgcaggacatgtgggaaaac

SEQ ID NO: 84931 - DNA, 22 bp, Homo sapiens
tgtcaggcgtgtgaatcacagc

SEQ ID NO: 84932 - DNA, 19 bp, Homo sapiens
tgcaagacgtgtgtaaagc

SEQ ID NO: 84933 - DNA, 18 bp, Homo sapiens
aaggtgtgtgaaaaagga

SEQ ID NO: 84934 - DNA, 23 bp, Homo sapiens
tgcaaagtatacaaagtagtgaa

SEQ ID NO: 84935 - DNA, 18 bp, Homo sapiens
gcaagacaggtggtgaac

SEQ ID NO: 84936 - DNA, 23 bp, Homo sapiens
tgcaggatcggtgggtagcgaac

SEQ ID NO: 84937 - DNA, 21 bp, Homo sapiens
tgtgagacgtgtcagacagga

SEQ ID NO: 84938 - DNA, 20 bp, Homo sapiens
tgtaaaacgtgtgtttgaac

SEQ ID NO: 84939 - DNA, 76 bp, Sulfolobus virus SIRV-2
atgcattatatattttatatgaattatagttgcaagagttacacgtaaaacaactcatatacattatataatgtat

SEQ ID NO: 84940 - DNA, 24 bp, Sulfolobus virus SIRV-2
tatatgaattatagttgcaagagt

SEQ ID NO: 84941 - DNA, 18 bp, Homo sapiens
tatatgaatcactaagag

SEQ ID NO: 84942 - DNA, 16 bp, Homo sapiens
tatgaattgccaagag

SEQ ID NO: 84943 - DNA, 98 bp, Equine herpesvirus 4
acagatttggggtggagacggcgtgggcgatactgtataaagttgtactacttaccagcccagtcagtgtgctgtagtgccaccacctgtaaagctgt

SEQ ID NO: 84944 - DNA, 24 bp, Equine herpesvirus 4
tggggtggagacggcgtgggcgat

SEQ ID NO: 84945 - DNA, 17 bp, Homo sapiens
tggggtggggatgggca

SEQ ID NO: 84946 - DNA, 18 bp, Homo sapiens
tggggcgggggcggggca

SEQ ID NO: 84947 - DNA, 16 bp, Homo sapiens
tggggtggggtgggga

SEQ ID NO: 84948 - DNA, 18 bp, Homo sapiens
tggggtggggatggtgga

SEQ ID NO: 84949 - DNA, 19 bp, Homo sapiens
tggggtgagaggcgggcga

SEQ ID NO: 84950 - DNA, 19 bp, Homo sapiens
tggggtggggacggccgga

SEQ ID NO: 84951 - DNA, 17 bp, Homo sapiens
tggggtggggaggtggg

SEQ ID NO: 84952 - DNA, 18 bp, Homo sapiens
tggcgtggaggtgcgtgg

SEQ ID NO: 84953 - DNA, 18 bp, Homo sapiens
tggggtgaggctggggcg

SEQ ID NO: 84954 - DNA, 16 bp, Homo sapiens
gggtggaggcggtggg

SEQ ID NO: 84955 - DNA, 16 bp, Homo sapiens
tggggtggggctggcg

SEQ ID NO: 84956 - DNA, 21 bp, Homo sapiens
tggggtgggggcgggtgggcg

SEQ ID NO: 84957 - DNA, 17 bp, Homo sapiens
tggggtgggggtggtga

SEQ ID NO: 84958 - DNA, 18 bp, Homo sapiens
tgaggtggagagtgggcg

SEQ ID NO: 84959 - DNA, 21 bp, Homo sapiens
tggggtggggaaggagaatgg

SEQ ID NO: 84960 - DNA, 21 bp, Homo sapiens
tggggtgggggcggctatggg

SEQ ID NO: 84961 - DNA, 17 bp, Homo sapiens
tggggaggagggggtgg

SEQ ID NO: 84962 - DNA, 18 bp, Homo sapiens
tgaggtgggggcaggtgg

SEQ ID NO: 84963 - DNA, 19 bp, Homo sapiens
tggggtggagatgggaggg

SEQ ID NO: 84964 - DNA, 20 bp, Homo sapiens
tggggtggagatactggtgg

SEQ ID NO: 84965 - DNA, 21 bp, Homo sapiens
tagggtggggacggcggcaac

SEQ ID NO: 84966 - DNA, 17 bp, Homo sapiens
tggggtggagagggcgg

SEQ ID NO: 84967 - DNA, 19 bp, Homo sapiens
tggggtggggagaggggcg

SEQ ID NO: 84968 - DNA, 23 bp, Homo sapiens
tggggatggagatggcgtgagga

SEQ ID NO: 84969 - DNA, 15 bp, Homo sapiens
tggggtgggggtggg

SEQ ID NO: 84970 - DNA, 25 bp, Homo sapiens
ggggtggggacggcgagaaggcgat

SEQ ID NO: 84971 - DNA, 15 bp, Homo sapiens
tggggtggaggggca

SEQ ID NO: 84972 - DNA, 23 bp, Homo sapiens
tggggtggggaaggccagaatgg

SEQ ID NO: 84973 - DNA, 18 bp, Homo sapiens
tggcgtgggggtagggcg

SEQ ID NO: 84974 - DNA, 17 bp, Homo sapiens
gggtggaggcgtgggcg

SEQ ID NO: 84975 - DNA, 21 bp, Homo sapiens
tggggtgggagaaatgggtgg

SEQ ID NO: 84976 - DNA, 20 bp, Homo sapiens
tggggtgaggttggagtggg

SEQ ID NO: 84977 - DNA, 16 bp, Homo sapiens
tggggggagctgggcg

SEQ ID NO: 84978 - DNA, 19 bp, Homo sapiens
tggggtggggctggtaagc

SEQ ID NO: 84979 - DNA, 22 bp, Homo sapiens
tggggtagggggtgggagtgat

SEQ ID NO: 84980 - DNA, 20 bp, Homo sapiens
tggggcggaggcggctctga

SEQ ID NO: 84981 - DNA, 19 bp, Homo sapiens
tggggtggggatgccaaga

SEQ ID NO: 84982 - DNA, 17 bp, Homo sapiens
tggggtggaggtgttcg

SEQ ID NO: 84983 - DNA, 19 bp, Homo sapiens
tggggtggaggtggcctga

SEQ ID NO: 84984 - DNA, 18 bp, Homo sapiens
tggggtggaggtgggaga

SEQ ID NO: 84985 - DNA, 19 bp, Homo sapiens
tagggtgggggcttggcga

SEQ ID NO: 84986 - DNA, 18 bp, Homo sapiens
ggggtggaggcgcacaca

SEQ ID NO: 84987 - DNA, 18 bp, Homo sapiens
tggggtgggggcggcggg

SEQ ID NO: 84988 - DNA, 21 bp, Homo sapiens
tggggtggaggtgggcgtggg

SEQ ID NO: 84989 - DNA, 18 bp, Homo sapiens
tggggtggggggggtgcg

SEQ ID NO: 84990 - DNA, 19 bp, Homo sapiens
tggggtgaggtggcactgg

SEQ ID NO: 84991 - DNA, 17 bp, Homo sapiens
tgggctggggatggtga

SEQ ID NO: 84992 - DNA, 19 bp, Homo sapiens
tggggtggggggaggggcg

SEQ ID NO: 84993 - DNA, 17 bp, Homo sapiens
ggggtggaggcggcggc

SEQ ID NO: 84994 - DNA, 22 bp, Homo sapiens
tggggcgggggcggcccgcacg

SEQ ID NO: 84995 - DNA, 20 bp, Homo sapiens
tggggtggcgatggttgtga

SEQ ID NO: 84996 - DNA, 23 bp, Homo sapiens
tggggtgaggatagactgggtgg

SEQ ID NO: 84997 - DNA, 15 bp, Homo sapiens
tggggtgggggggcg

SEQ ID NO: 84998 - DNA, 62 bp, Amsacta moorei entomopoxvirus
ttattgataaggattaatgattatttaacaaattaaataattatattatagcttatcaataa

SEQ ID NO: 84999 - DNA, 24 bp, Amsacta moorei entomopoxvirus
taaggattaatgattatttaacaa

SEQ ID NO: 85000 - DNA, 20 bp, Homo sapiens
tgagattaatgattaaataa

SEQ ID NO: 85001 - DNA, 17 bp, Homo sapiens
ggataatgattaaaaac

SEQ ID NO: 85002 - DNA, 21 bp, Homo sapiens
taaggattaatattaattcaa

SEQ ID NO: 85003 - DNA, 18 bp, Homo sapiens
taaggataatgattactt

SEQ ID NO: 85004 - DNA, 22 bp, Homo sapiens
aggggtaaggaacatttaacaa

SEQ ID NO: 85005 - DNA, 20 bp, Homo sapiens
taaggattaatgtattaatc

SEQ ID NO: 85006 - DNA, 17 bp, Homo sapiens
agggcatgattatttaa

SEQ ID NO: 85007 - DNA, 19 bp, Homo sapiens
aggattaagtgaaataaca

SEQ ID NO: 85008 - DNA, 64 bp, Rat cytomegalovirus
tcggggggaggagaggaaaccggggactcaccggcggcctcggaccgagcctcgctcccgccgg

SEQ ID NO: 85009 - DNA, 24 bp, Rat cytomegalovirus
agaggaaaccggggactcaccggc

SEQ ID NO: 85010 - DNA, 18 bp, Homo sapiens
gaggagacagggggctca

SEQ ID NO: 85011 - DNA, 18 bp, Homo sapiens
agaggagacggggaccag

SEQ ID NO: 85012 - DNA, 21 bp, Homo sapiens
gagggaccggagaacactggc

SEQ ID NO: 85013 - DNA, 20 bp, Homo sapiens
gaggaagcgggagacccggc

SEQ ID NO: 85014 - DNA, 19 bp, Homo sapiens
agaggaaatcggagggcgg

SEQ ID NO: 85015 - DNA, 18 bp, Homo sapiens
agaggaaaatggagctgg

SEQ ID NO: 85016 - DNA, 18 bp, Homo sapiens
aggcggggaccggtccag

SEQ ID NO: 85017 - DNA, 17 bp, Homo sapiens
gaggaggcggggaccgg

SEQ ID NO: 85018 - DNA, 17 bp, Homo sapiens
gagggaaccgggagcgg

SEQ ID NO: 85019 - DNA, 19 bp, Homo sapiens
agggaggccacttcgccgg

SEQ ID NO: 85020 - DNA, 21 bp, Homo sapiens
aggggggccggggaccccggc

SEQ ID NO: 85021 - DNA, 18 bp, Homo sapiens
ggaggggacccggcccgg

SEQ ID NO: 85022 - DNA, 18 bp, Homo sapiens
agagagaggccgggccgg

SEQ ID NO: 85023 - DNA, 15 bp, Homo sapiens
agaggccggggaccc

SEQ ID NO: 85024 - DNA, 23 bp, Homo sapiens
gggccctgctggggactcgccgg

SEQ ID NO: 85025 - DNA, 21 bp, Homo sapiens
agcgggggctggggacccggc

SEQ ID NO: 85026 - DNA, 22 bp, Homo sapiens
agaggggcccggggactcaggc

SEQ ID NO: 85027 - DNA, 21 bp, Homo sapiens
agagggaactggggcaggagc

SEQ ID NO: 85028 - DNA, 18 bp, Homo sapiens
ggaaaccgcggcctcggc

SEQ ID NO: 85029 - DNA, 21 bp, Homo sapiens
agaggaaagcgactcgttggc

SEQ ID NO: 85030 - DNA, 21 bp, Homo sapiens
gagagcgcggggctcgctggc

SEQ ID NO: 85031 - DNA, 22 bp, Homo sapiens
gagggggctggagacccggggc

SEQ ID NO: 85032 - DNA, 17 bp, Homo sapiens
gaggaaaccagagttgg

SEQ ID NO: 85033 - DNA, 22 bp, Homo sapiens
aaaggaaacacccctcactggc

SEQ ID NO: 85034 - DNA, 18 bp, Homo sapiens
ggaaaccgagtccctggc

SEQ ID NO: 85035 - DNA, 21 bp, Homo sapiens
agaggaaatggtacttactgg

SEQ ID NO: 85036 - DNA, 22 bp, Homo sapiens
aggggacactggggactctggc

SEQ ID NO: 85037 - DNA, 23 bp, Homo sapiens
agagggagcccgtgctcaccggc

SEQ ID NO: 85038 - DNA, 19 bp, Homo sapiens
ggggaccgggctcgccggc

SEQ ID NO: 85039 - DNA, 21 bp, Homo sapiens
aaggagcctggactcactggc

SEQ ID NO: 85040 - DNA, 24 bp, Homo sapiens
gaggaactcggagacactcactgg

SEQ ID NO: 85041 - DNA, 22 bp, Homo sapiens
gaggatgctggggagacagggc

SEQ ID NO: 85042 - DNA, 30 bp, Homo sapiens
aaggaaactgggggtgcacactcgctggcg

SEQ ID NO: 85043 - DNA, 20 bp, Homo sapiens
agggaaaccggggaaatcgg

SEQ ID NO: 85044 - DNA, 22 bp, Homo sapiens
agaggaaacttgggcctgtggc

SEQ ID NO: 85045 - DNA, 18 bp, Homo sapiens
ggacggagactgggccgg

SEQ ID NO: 85046 - DNA, 18 bp, Homo sapiens
gagaagccaacttactgg

SEQ ID NO: 85047 - DNA, 18 bp, Homo sapiens
agaagaaaccgggcccgg

SEQ ID NO: 85048 - DNA, 19 bp, Homo sapiens
agaggcaaccggagaccgg

SEQ ID NO: 85049 - DNA, 23 bp, Homo sapiens
agaagaaacctctggctcattgg

SEQ ID NO: 85050 - DNA, 20 bp, Homo sapiens
gaggaaactgggtgaaaggc

SEQ ID NO: 85051 - DNA, 18 bp, Homo sapiens
agaggaaactgggagagg

SEQ ID NO: 85052 - DNA, 16 bp, Homo sapiens
agaggatcggggaccc

SEQ ID NO: 85053 - DNA, 21 bp, Homo sapiens
aaggaaactggcaccattggc

SEQ ID NO: 85054 - DNA, 16 bp, Homo sapiens
agaggaaacctgactg

SEQ ID NO: 85055 - DNA, 71 bp, Meleagrid herpesvirus 1
aggctgtccggaaatctaagttaatgaataaagtagatggttaatactcattgcttagaattggactactt

SEQ ID NO: 85056 - DNA, 24 bp, Meleagrid herpesvirus 1
taagttaatgaataaagtagatgg

SEQ ID NO: 85057 - DNA, 22 bp, Homo sapiens
taagttaataataatgtattgg

SEQ ID NO: 85058 - DNA, 27 bp, Homo sapiens
taagttaataaatagactggtggatgg

SEQ ID NO: 85059 - DNA, 21 bp, Homo sapiens
ttaatgaatttcagcaggtgg

SEQ ID NO: 85060 - DNA, 19 bp, Homo sapiens
gttaagaaaaagtagatgg

SEQ ID NO: 85061 - DNA, 18 bp, Homo sapiens
taagttattgaataaatg

SEQ ID NO: 85062 - DNA, 23 bp, Homo sapiens
taagttaatgaaaagatatatgg

SEQ ID NO: 85063 - DNA, 23 bp, Homo sapiens
gttaataaataattgattgatgg

SEQ ID NO: 85064 - DNA, 18 bp, Homo sapiens
gttatacaaagtagatgg

SEQ ID NO: 85065 - DNA, 75 bp, Human parainfluenza virus 1 strain Washington/1964
taaatagtattttagggttaaagtaatactttaaagggacaagtcacagacatttgatcttagtataaattttta

SEQ ID NO: 85066 - DNA, 24 bp, Human parainfluenza virus 1 strain Washington/1964
ttttagggttaaagtaatacttta

SEQ ID NO: 85067 - DNA, 18 bp, Homo sapiens
tttaagggttagagtaat

SEQ ID NO: 85068 - DNA, 18 bp, Homo sapiens
ttttagggtaagtacttt

SEQ ID NO: 85069 - DNA, 24 bp, Homo sapiens
ttttagagttggttcaatacttta

SEQ ID NO: 85070 - DNA, 73 bp, Chimpanzee cytomegalovirus
ctgatgtcccgtccggtttttaacacggtcccgggcccgtgacgacattaaataggaagggacggggtggggg

SEQ ID NO: 85071 - DNA, 24 bp, Chimpanzee cytomegalovirus
acgacattaaataggaagggacgg

SEQ ID NO: 85072 - DNA, 22 bp, Homo sapiens
acagcattaaataggaactacg

SEQ ID NO: 85073 - DNA, 18 bp, Homo sapiens
cgcacacaggaaggggcg

SEQ ID NO: 85074 - DNA, 21 bp, Homo sapiens
acgaacagagggaggggatgg

SEQ ID NO: 85075 - DNA, 16 bp, Homo sapiens
attaaataggaaacag

SEQ ID NO: 85076 - DNA, 16 bp, Homo sapiens
gacattaaggggagac

SEQ ID NO: 85077 - DNA, 16 bp, Homo sapiens
acattaaataggagac

SEQ ID NO: 85078 - DNA, 18 bp, Homo sapiens
gacactgggtagggacag

SEQ ID NO: 85079 - DNA, 18 bp, Homo sapiens
gacattaaatggtaaagg

SEQ ID NO: 85080 - DNA, 19 bp, Homo sapiens
attaaagaagggggggcgg

SEQ ID NO: 85081 - DNA, 21 bp, Homo sapiens
acgacattaacgctgggacgg

SEQ ID NO: 85082 - DNA, 18 bp, Homo sapiens
ccaaagaggaaggggtgg

SEQ ID NO: 85083 - DNA, 26 bp, Homo sapiens
cggcatgagggacagggagggggcgg

SEQ ID NO: 85084 - DNA, 18 bp, Homo sapiens
gacatcgggaagggacgg

SEQ ID NO: 85085 - DNA, 108 bp, Cucumber mosaic virus
aatcttaccactgtgtgtgtgcgtgtgtgtgtgtcgagtcgtgttgtccgcacatttgagtcgtgctgtccgcacatattttatcttttgggtacagtgtgttagatt

SEQ ID NO: 85086 - DNA, 24 bp, Cucumber mosaic virus
tcgtgctgtccgcacatattttat

SEQ ID NO: 85087 - DNA, 18 bp, Homo sapiens
tatctgcacatattttat

SEQ ID NO: 85088 - DNA, 20 bp, Homo sapiens
atgctgtttgcatctcctat

SEQ ID NO: 85089 - DNA, 109 bp, Pepper ringspot virus
tagtattgaaaaggtgtttgtatttatgtatatttggtttcttcaagtagccctataggcgctatttgatgcatattgaatatcacatatttgcacagcattcaaactg

SEQ ID NO: 85090 - DNA, 24 bp, Pepper ringspot virus
tttgatgcatattgaatatcacat

SEQ ID NO: 85091 - DNA, 20 bp, Homo sapiens
tgatgcttcaaatatcacat

SEQ ID NO: 85092 - DNA, 24 bp, Homo sapiens
ttcgatgcatattgtggcagtcac

SEQ ID NO: 85093 - DNA, 22 bp, Homo sapiens
tttgtgcatggaggtatcacat

SEQ ID NO: 85094 - DNA, 117 bp, Paramecium bursaria Chlorella virus 1
ttttgttcatacgtatagtcttcttaagtttttaatatttgtttatcgatacgctaacacccgtctcgaaacgatgttatttttaatttaagaaactttaaaataaaaataacaaaa

SEQ ID NO: 85095 - DNA, 24 bp, Paramecium bursaria Chlorella virus 1
tcgaaacgatgttatttttaattt

SEQ ID NO: 85096 - DNA, 20 bp, Homo sapiens
gaaacaatcacttttaattt

SEQ ID NO: 85097 - DNA, 89 bp, Rice black streaked dwarf virus
gactgtttgtgcatgtgttttggaaggatgttggaaactgtcacgtgagctctcccctagccttttgacataccgtgttgtggcggctc

SEQ ID NO: 85098 - DNA, 24 bp, Rice black streaked dwarf virus
tggaaggatgttggaaactgtcac

SEQ ID NO: 85099 - DNA, 25 bp, Homo sapiens
tggggtgatgccaagaggattgtca

SEQ ID NO: 85100 - DNA, 22 bp, Homo sapiens
agggcaatttggaaactgtcac

SEQ ID NO: 85101 - DNA, 19 bp, Homo sapiens
gggagggtgtgacttgtca

SEQ ID NO: 85102 - DNA, 19 bp, Homo sapiens
tgggggaatgttgatgtca

SEQ ID NO: 85103 - DNA, 15 bp, Homo sapiens
gaaggatgttgggtc

SEQ ID NO: 85104 - DNA, 21 bp, Homo sapiens
tagaaggaatgagaactgtca

SEQ ID NO: 85105 - DNA, 21 bp, Homo sapiens
tggagtggtttggactgtcac

SEQ ID NO: 85106 - DNA, 15 bp, Homo sapiens
agaaggaaaactgtc

SEQ ID NO: 85107 - DNA, 18 bp, Homo sapiens
tgagaggatgttggaaac

SEQ ID NO: 85108 - DNA, 22 bp, Homo sapiens
gaaggatgtatttcactgtcac

SEQ ID NO: 85109 - DNA, 21 bp, Homo sapiens
gggggggccggaaaaattgtc

SEQ ID NO: 85110 - DNA, 18 bp, Homo sapiens
gattgttggaagctgtca

SEQ ID NO: 85111 - DNA, 21 bp, Homo sapiens
ggcatgcctggggactgtcac

SEQ ID NO: 85112 - DNA, 20 bp, Homo sapiens
gggaggacagggaactgtca

SEQ ID NO: 85113 - DNA, 18 bp, Homo sapiens
tggaggaagaagctgtca

SEQ ID NO: 85114 - DNA, 16 bp, Homo sapiens
tggaaggatttgggtc

SEQ ID NO: 85115 - DNA, 21 bp, Homo sapiens
tgggaggaggctgaactgtca

SEQ ID NO: 85116 - DNA, 22 bp, Homo sapiens
ggaaggattaaagaagttgtca

SEQ ID NO: 85117 - DNA, 17 bp, Homo sapiens
tggaagggttgcctgtc

SEQ ID NO: 85118 - DNA, 19 bp, Homo sapiens
tggaatgaatgggctgtca

SEQ ID NO: 85119 - DNA, 22 bp, Homo sapiens
gggaggctgtggggactgtcac

SEQ ID NO: 85120 - DNA, 22 bp, Homo sapiens
tggaaggaggttctgcggctgt

SEQ ID NO: 85121 - DNA, 22 bp, Homo sapiens
ggaaggctggtggaactgtcac

SEQ ID NO: 85122 - DNA, 24 bp, Homo sapiens
tggggggtgggcggaaactgtcac

SEQ ID NO: 85123 - DNA, 22 bp, Homo sapiens
gaaggatgactagggctgtcac

SEQ ID NO: 85124 - DNA, 18 bp, Homo sapiens
gagggaggaaaattgtca

SEQ ID NO: 85125 - DNA, 114 bp, Human herpesvirus 5
cgataagtcgcgtgtaggcgactggctacatcaaccggatatctgcggggatttaaaaagacgacccgttgtcatccggcttagaccaaaccgtccttttatcatcttccgtcg

SEQ ID NO: 85126 - DNA, 24 bp, Human herpesvirus 5
aaccggatatctgcggggatttaa

SEQ ID NO: 85127 - DNA, 20 bp, Homo sapiens
aactggaaatctgtgcgtgg

SEQ ID NO: 85128 - DNA, 19 bp, Homo sapiens
acctgggcgctggggattt

SEQ ID NO: 85129 - DNA, 15 bp, Homo sapiens
ggattggaggattta

SEQ ID NO: 85130 - DNA, 18 bp, Homo sapiens
cagatattgcagatttaa

SEQ ID NO: 85131 - DNA, 19 bp, Homo sapiens
ggacatctgcatatcttaa

SEQ ID NO: 85132 - DNA, 19 bp, Homo sapiens
cctggatgttaaggattta

SEQ ID NO: 85133 - DNA, 92 bp, Cercopithecine herpesvirus 7
tatatggtgcactatgtaaacgacattatgggcgtgcttttaaatgccgtgtctgttcacacttcattaaaatatttggtgcgtttcatgta

SEQ ID NO: 85134 - DNA, 24 bp, Cercopithecine herpesvirus 7
tatggtgcactatgtaaacgacat

SEQ ID NO: 85135 - DNA, 21 bp, Homo sapiens
catggtacctgtaaatgacat

SEQ ID NO: 85136 - DNA, 22 bp, Homo sapiens
tatgatgcattgaggatgacat

SEQ ID NO: 85137 - DNA, 23 bp, Homo sapiens
tatggtaccttcgtaagtgacat

SEQ ID NO: 85138 - DNA, 72 bp, Meleagrid herpesvirus 1
ccccatgggctctcttctagaaacgaaaatggtgctcgaaacaaaaactaggcacttggtgagagaaagggg

SEQ ID NO: 85139 - DNA, 20 bp, Meleagrid herpesvirus 1
cacttggtgagagaaagggg

SEQ ID NO: 85140 - DNA, 20 bp, Homo sapiens
cacttgggggaaaaaagggg

SEQ ID NO: 85141 - DNA, 16 bp, Homo sapiens
cctggggagaaagggg

SEQ ID NO: 85142 - DNA, 19 bp, Homo sapiens
cacctggtggaactcgggg

SEQ ID NO: 85143 - DNA, 15 bp, Homo sapiens
cactagaagaaaggg

SEQ ID NO: 85144 - DNA, 16 bp, Homo sapiens
cttagaaagagagggg

SEQ ID NO: 85145 - DNA, 24 bp, Homo sapiens
cctggtaagttgggagggaggggc

SEQ ID NO: 85146 - DNA, 20 bp, Homo sapiens
tggcagcggagggaaagggg

SEQ ID NO: 85147 - DNA, 18 bp, Homo sapiens
ctgggtgggagaaagggg

SEQ ID NO: 85148 - DNA, 17 bp, Homo sapiens
cttggtgagagacgggg

SEQ ID NO: 85149 - DNA, 22 bp, Homo sapiens
catttgtttaaaaagggagggg

SEQ ID NO: 85150 - DNA, 19 bp, Homo sapiens
cctgaccccgagaaagggg

SEQ ID NO: 85151 - DNA, 20 bp, Homo sapiens
cacatacgaggagaaagggg

SEQ ID NO: 85152 - DNA, 19 bp, Homo sapiens
ctatctgcagagaaagggg

SEQ ID NO: 85153 - DNA, 20 bp, Homo sapiens
catctggtgagaggagaggg

SEQ ID NO: 85154 - DNA, 16 bp, Homo sapiens
ctgagcgagagagggg

SEQ ID NO: 85155 - DNA, 19 bp, Homo sapiens
cacttgtttaaaaaagggg

SEQ ID NO: 85156 - DNA, 15 bp, Homo sapiens
cacctggcagagggg

SEQ ID NO: 85157 - DNA, 21 bp, Homo sapiens
cactaggtgcaggaaaagggg

SEQ ID NO: 85158 - DNA, 15 bp, Homo sapiens
cacttcgaaagaggg

SEQ ID NO: 85159 - DNA, 17 bp, Homo sapiens
cactgcggggagagggg

SEQ ID NO: 85160 - DNA, 18 bp, Homo sapiens
acttgatatctgaggggg

SEQ ID NO: 85161 - DNA, 19 bp, Homo sapiens
cactttggaaaaggagggg

SEQ ID NO: 85162 - DNA, 17 bp, Homo sapiens
cagttggtgaggacagg

SEQ ID NO: 85163 - DNA, 16 bp, Homo sapiens
cctgagcggaaagggg

SEQ ID NO: 85164 - DNA, 26 bp, Homo sapiens
cacctagcagtgtgggagaagggggc

SEQ ID NO: 85165 - DNA, 19 bp, Homo sapiens
accgagggggagaaagggg

SEQ ID NO: 85166 - DNA, 18 bp, Homo sapiens
catctgacaagagagggg

SEQ ID NO: 85167 - DNA, 15 bp, Homo sapiens
cacctgtgaaagggg

SEQ ID NO: 85168 - DNA, 18 bp, Homo sapiens
cacttagtggggaggggg

SEQ ID NO: 85169 - DNA, 18 bp, Homo sapiens
ggcagagggagaaagggg

SEQ ID NO: 85170 - DNA, 19 bp, Homo sapiens
cacctggcagaggaagggg

SEQ ID NO: 85171 - DNA, 22 bp, Homo sapiens
ttggtgagtattaagagggggg

SEQ ID NO: 85172 - DNA, 17 bp, Homo sapiens
cacctaggggaaagggg

SEQ ID NO: 85173 - DNA, 18 bp, Homo sapiens
ttgagaaagaggaagggg

SEQ ID NO: 85174 - DNA, 19 bp, Homo sapiens
acaaaagcagagagagggg

SEQ ID NO: 85175 - DNA, 18 bp, Homo sapiens
catttgtcaagaaagggg

SEQ ID NO: 85176 - DNA, 19 bp, Homo sapiens
tggtgagacagatcagggg

SEQ ID NO: 85177 - DNA, 15 bp, Homo sapiens
cactggtaaaagggg

SEQ ID NO: 85178 - DNA, 16 bp, Homo sapiens
acttaaaaggaagggg

SEQ ID NO: 85179 - DNA, 18 bp, Homo sapiens
cactccgccggaaagggg

SEQ ID NO: 85180 - DNA, 17 bp, Homo sapiens
ccaggcagagaaagggg

SEQ ID NO: 85181 - DNA, 18 bp, Homo sapiens
actaggtgagagactagg

SEQ ID NO: 85182 - DNA, 17 bp, Homo sapiens
cacttggcagagggggg

SEQ ID NO: 85183 - DNA, 18 bp, Homo sapiens
ttggtgagaaatttgggg

SEQ ID NO: 85184 - DNA, 15 bp, Homo sapiens
cacccgggaaagggg

SEQ ID NO: 85185 - DNA, 20 bp, Homo sapiens
actgaggagggagaaagggg

SEQ ID NO: 85186 - DNA, 18 bp, Homo sapiens
cttcctgagggaaagggg

SEQ ID NO: 85187 - DNA, 17 bp, Homo sapiens
actctgagggagagggg

SEQ ID NO: 85188 - DNA, 17 bp, Homo sapiens
catttggtaagataggg

SEQ ID NO: 85189 - DNA, 21 bp, Homo sapiens
cttggtgacaacgtgaagggg

SEQ ID NO: 85190 - DNA, 17 bp, Homo sapiens
cttgtaccagaaagggg

SEQ ID NO: 85191 - DNA, 18 bp, Homo sapiens
catccagggagaaagggg

SEQ ID NO: 85192 - DNA, 20 bp, Homo sapiens
acctggcacccagagagggg

SEQ ID NO: 85193 - DNA, 18 bp, Homo sapiens
cactattacagaaagggg

SEQ ID NO: 85194 - DNA, 19 bp, Homo sapiens
ctcggaaagagggaagggg

SEQ ID NO: 85195 - DNA, 20 bp, Homo sapiens
actttccagagagaaagggg

SEQ ID NO: 85196 - DNA, 17 bp, Homo sapiens
acttggtgagaactggg

SEQ ID NO: 85197 - DNA, 20 bp, Homo sapiens
tggctttaaagagaaagggg

SEQ ID NO: 85198 - DNA, 19 bp, Homo sapiens
ttggaggaaagggaagggg

SEQ ID NO: 85199 - DNA, 20 bp, Homo sapiens
acatcagtgagggaaagggg

SEQ ID NO: 85200 - DNA, 17 bp, Homo sapiens
cacctggtgagaaaagg

SEQ ID NO: 85201 - DNA, 20 bp, Homo sapiens
acttagtgggaggaataggg

SEQ ID NO: 85202 - DNA, 20 bp, Homo sapiens
cacttcgcgcgggaaagggg

SEQ ID NO: 85203 - DNA, 21 bp, Homo sapiens
acttggtaagatggagagggg

SEQ ID NO: 85204 - DNA, 18 bp, Homo sapiens
cttggggcaggaaagggg

SEQ ID NO: 85205 - DNA, 21 bp, Homo sapiens
cacgtggacacagggaagggg

SEQ ID NO: 85206 - DNA, 16 bp, Homo sapiens
cacttggtggaacagg

SEQ ID NO: 85207 - DNA, 19 bp, Homo sapiens
actaaataagaggaagggg

SEQ ID NO: 85208 - DNA, 21 bp, Homo sapiens
ttggaaagaaagagaaagggg

SEQ ID NO: 85209 - DNA, 18 bp, Homo sapiens
ctctgcttgagaaagggg

SEQ ID NO: 85210 - DNA, 17 bp, Homo sapiens
acttggtgaccaagggg

SEQ ID NO: 85211 - DNA, 17 bp, Homo sapiens
acttggaaagaaagggg

SEQ ID NO: 85212 - DNA, 18 bp, Homo sapiens
tggctttaaggaaagggg

SEQ ID NO: 85213 - DNA, 17 bp, Homo sapiens
cacatggtgagacaggg

SEQ ID NO: 85214 - DNA, 18 bp, Homo sapiens
cacctggtgacgaggggg

SEQ ID NO: 85215 - DNA, 23 bp, Homo sapiens
cacttggcggggggagggagggg

SEQ ID NO: 85216 - DNA, 20 bp, Homo sapiens
cttaaaaggagaggaagggg

SEQ ID NO: 85217 - DNA, 20 bp, Homo sapiens
catttagcaagaagaagggg

SEQ ID NO: 85218 - DNA, 17 bp, Homo sapiens
acaagaagaggaagggg

SEQ ID NO: 85219 - DNA, 17 bp, Homo sapiens
cacttgatgaggcaagg

SEQ ID NO: 85220 - DNA, 19 bp, Homo sapiens
cctactaaaaggggagggg

SEQ ID NO: 85221 - DNA, 15 bp, Homo sapiens
cactcatggaaaggg

SEQ ID NO: 85222 - DNA, 19 bp, Homo sapiens
actggtgaggagcatgggg

SEQ ID NO: 85223 - DNA, 18 bp, Homo sapiens
cacatcaagagaaagggg

SEQ ID NO: 85224 - DNA, 18 bp, Homo sapiens
cacttggtaagggaaagg

SEQ ID NO: 85225 - DNA, 17 bp, Homo sapiens
cacttggtggagctggg

SEQ ID NO: 85226 - DNA, 18 bp, Homo sapiens
cacctggcaggggagggg

SEQ ID NO: 85227 - DNA, 19 bp, Homo sapiens
tggtttggaaaggaagggg

SEQ ID NO: 85228 - DNA, 17 bp, Homo sapiens
ctcagtagagaaagggg

SEQ ID NO: 85229 - DNA, 19 bp, Homo sapiens
acttagtgggagagagggg

SEQ ID NO: 85230 - DNA, 18 bp, Homo sapiens
ccttttacaggaaagggg

SEQ ID NO: 85231 - DNA, 16 bp, Homo sapiens
acatggaggaaagggg

SEQ ID NO: 85232 - DNA, 21 bp, Homo sapiens
cctggtgggaaaggagagggg

SEQ ID NO: 85233 - DNA, 18 bp, Homo sapiens
cacttggtaagaacaagg

SEQ ID NO: 85234 - DNA, 18 bp, Homo sapiens
ctggaggaaagaaggggg

SEQ ID NO: 85235 - DNA, 18 bp, Homo sapiens
cactaggtgagaattggg

SEQ ID NO: 85236 - DNA, 18 bp, Homo sapiens
ccttctgaaagaaggggg

SEQ ID NO: 85237 - DNA, 20 bp, Homo sapiens
cactctgcaagagaaggggg

SEQ ID NO: 85238 - DNA, 16 bp, Homo sapiens
actggtgaggaagggg

SEQ ID NO: 85239 - DNA, 17 bp, Homo sapiens
ctctttggagaaagggg

SEQ ID NO: 85240 - DNA, 18 bp, Homo sapiens
ttgaataaaagaaagggg

SEQ ID NO: 85241 - DNA, 18 bp, Homo sapiens
cactaatggagaaagggg

SEQ ID NO: 85242 - DNA, 18 bp, Homo sapiens
ctggtgaggaggaagggg

SEQ ID NO: 85243 - DNA, 17 bp, Homo sapiens
cttttaaaagaaagggg

SEQ ID NO: 85244 - DNA, 19 bp, Homo sapiens
actggtgaggacaatgggg

SEQ ID NO: 85245 - DNA, 16 bp, Homo sapiens
cactgggagaaagggg

SEQ ID NO: 85246 - DNA, 16 bp, Homo sapiens
acttgatgggaggggg

SEQ ID NO: 85247 - DNA, 22 bp, Homo sapiens
cactcggccagccagagagggg

SEQ ID NO: 85248 - DNA, 19 bp, Homo sapiens
ctccatgtggagaaagggg

SEQ ID NO: 85249 - DNA, 17 bp, Homo sapiens
cacttcaaggaaagggg

SEQ ID NO: 85250 - DNA, 19 bp, Homo sapiens
cactgggagaaaggagggg

SEQ ID NO: 85251 - DNA, 20 bp, Homo sapiens
cacttggctgaggctaaggg

SEQ ID NO: 85252 - DNA, 18 bp, Homo sapiens
ctgatgaagagggagggg

SEQ ID NO: 85253 - DNA, 18 bp, Homo sapiens
tggtgggagggaggggcc

SEQ ID NO: 85254 - DNA, 18 bp, Homo sapiens
tgtgtgcagagaaagggg

SEQ ID NO: 85255 - DNA, 17 bp, Homo sapiens
acctgcaaggaaagggg

SEQ ID NO: 85256 - DNA, 19 bp, Homo sapiens
cttggtgagaactgagggg

SEQ ID NO: 85257 - DNA, 17 bp, Homo sapiens
cacttggtgagtgatgg

SEQ ID NO: 85258 - DNA, 19 bp, Homo sapiens
ttggtgagaatcacagggg

SEQ ID NO: 85259 - DNA, 19 bp, Homo sapiens
tgcttgagaaaaggagggg

SEQ ID NO: 85260 - DNA, 15 bp, Homo sapiens
cctgggagaaagggg

SEQ ID NO: 85261 - DNA, 21 bp, Homo sapiens
cacttgagtggaaaggagggg

SEQ ID NO: 85262 - DNA, 19 bp, Homo sapiens
cactggtgagaccacaggg

SEQ ID NO: 85263 - DNA, 19 bp, Homo sapiens
cattcggcaaggaaagggg

SEQ ID NO: 85264 - DNA, 19 bp, Homo sapiens
cacatggaaataaaagggg

SEQ ID NO: 85265 - DNA, 20 bp, Homo sapiens
cactgtcccagagaaagggg

SEQ ID NO: 85266 - DNA, 18 bp, Homo sapiens
cttagtgagaacccaagg

SEQ ID NO: 85267 - DNA, 19 bp, Homo sapiens
acctaaagagagaaagggg

SEQ ID NO: 85268 - DNA, 15 bp, Homo sapiens
cttgggagaaagggg

SEQ ID NO: 85269 - DNA, 20 bp, Homo sapiens
actacagcaagagaaagggg

SEQ ID NO: 85270 - DNA, 19 bp, Homo sapiens
ttggtgaagagtataaggg

SEQ ID NO: 85271 - DNA, 18 bp, Homo sapiens
acatagccaagaaagggg

SEQ ID NO: 85272 - DNA, 20 bp, Homo sapiens
cttggagaatgaggaagggg

SEQ ID NO: 85273 - DNA, 18 bp, Homo sapiens
tggaaggagagaaagggg

SEQ ID NO: 85274 - DNA, 20 bp, Homo sapiens
cacttggacacaggaagggg

SEQ ID NO: 85275 - DNA, 22 bp, Homo sapiens
cagttggtgagtggcccagggg

SEQ ID NO: 85276 - DNA, 19 bp, Homo sapiens
cacatggtgagaatgaggg

SEQ ID NO: 85277 - DNA, 15 bp, Homo sapiens
cacctggtagaaggg

SEQ ID NO: 85278 - DNA, 20 bp, Homo sapiens
catttggcaagaggaagggg

SEQ ID NO: 85279 - DNA, 19 bp, Homo sapiens
cactgggatttgaaagggg

SEQ ID NO: 85280 - DNA, 63 bp, Molluscum contagiosum virus
tttgtgttttgtgcgttgcctggcaaacgcgatttgggtgcgtgtgtccgagcaagccacgga

SEQ ID NO: 85281 - DNA, 21 bp, Molluscum contagiosum virus
tgtgtccgagcaagccacgga

SEQ ID NO: 85282 - DNA, 17 bp, Homo sapiens
tgtgtccgcgcgaaggg

SEQ ID NO: 85283 - DNA, 19 bp, Homo sapiens
tgtgtccggcaggccaggg

SEQ ID NO: 85284 - DNA, 20 bp, Homo sapiens
tgtcgtctaaggagccacgg

SEQ ID NO: 85285 - DNA, 23 bp, Homo sapiens
tgtgtccagtggcagggctgcgg

SEQ ID NO: 85286 - DNA, 19 bp, Homo sapiens
tgtgtccaggaccgagcgg

SEQ ID NO: 85287 - DNA, 17 bp, Homo sapiens
tgcgtcaacagccacgg

SEQ ID NO: 85288 - DNA, 18 bp, Homo sapiens
tgtgtccagcagccaggg

SEQ ID NO: 85289 - DNA, 20 bp, Homo sapiens
tgtgtccggggcagggcgga

SEQ ID NO: 85290 - DNA, 17 bp, Homo sapiens
tgtgtccgggcagcagg

SEQ ID NO: 85291 - DNA, 20 bp, Homo sapiens
tgtgttcaagcaaagaatgg

SEQ ID NO: 85292 - DNA, 18 bp, Homo sapiens
tgtgtctgagagccacga

SEQ ID NO: 85293 - DNA, 17 bp, Homo sapiens
tgttctgagcaagctgg

SEQ ID NO: 85294 - DNA, 17 bp, Homo sapiens
tgtgtccgagccgcagg

SEQ ID NO: 85295 - DNA, 18 bp, Homo sapiens
tgcgtccgcaccccacgg

SEQ ID NO: 85296 - DNA, 20 bp, Homo sapiens
tgtgcccacgctggccgtgg

SEQ ID NO: 85297 - DNA, 19 bp, Homo sapiens
tgggttgaagcagccacgg

SEQ ID NO: 85298 - DNA, 22 bp, Homo sapiens
tgtgtttgggcgcacaccagga

SEQ ID NO: 85299 - DNA, 21 bp, Homo sapiens
tgtgtccagtgagaaagtgga

SEQ ID NO: 85300 - DNA, 19 bp, Homo sapiens
tgtgtccggggaagccagg

SEQ ID NO: 85301 - DNA, 18 bp, Homo sapiens
tccgtagcaagccatgga

SEQ ID NO: 85302 - DNA, 16 bp, Homo sapiens
tgtgtccacaatacgg

SEQ ID NO: 85303 - DNA, 17 bp, Homo sapiens
gtgaaaccaagccacgg

SEQ ID NO: 85304 - DNA, 20 bp, Homo sapiens
tgtgtccgagtcgatcacga

SEQ ID NO: 85305 - DNA, 22 bp, Homo sapiens
tgtgtccgaagtggtgcttgga

SEQ ID NO: 85306 - DNA, 18 bp, Homo sapiens
tgtgtccgacaggacgga

SEQ ID NO: 85307 - DNA, 18 bp, Homo sapiens
tgtctccgagcaaaacga

SEQ ID NO: 85308 - DNA, 18 bp, Homo sapiens
tatgtccagcagctgtgg

SEQ ID NO: 85309 - DNA, 19 bp, Homo sapiens
tgagttcccaggccacgga

SEQ ID NO: 85310 - DNA, 18 bp, Homo sapiens
tgtgtccagtaatcagga

SEQ ID NO: 85311 - DNA, 18 bp, Homo sapiens
tgtgcccggcacctgcgg

SEQ ID NO: 85312 - DNA, 18 bp, Homo sapiens
tgagtccgagcagcagga

SEQ ID NO: 85313 - DNA, 21 bp, Homo sapiens
gtgtccacagccaggccgcgg

SEQ ID NO: 85314 - DNA, 21 bp, Homo sapiens
tggtccacagcaagccacgga

SEQ ID NO: 85315 - DNA, 18 bp, Homo sapiens
tgtgtccgacacactgga

SEQ ID NO: 85316 - DNA, 19 bp, Homo sapiens
tgtgcccgggcaccccgga

SEQ ID NO: 85317 - DNA, 18 bp, Homo sapiens
tggtcctccagccacgga

SEQ ID NO: 85318 - DNA, 18 bp, Homo sapiens
tgtgtccacatcacacgg

SEQ ID NO: 85319 - DNA, 88 bp, Paramecium bursaria Chlorella virus 1
agtttgtatatttaagaatgaaaataaaatattttcgaagcgattataaagttcaatttgtcatttgtcatttttgtgtatatcaact

SEQ ID NO: 85320 - DNA, 24 bp, Paramecium bursaria Chlorella virus 1
tttaagaatgaaaataaaatattt

SEQ ID NO: 85321 - DNA, 20 bp, Homo sapiens
aaaatgaaaatagaatattt

SEQ ID NO: 85322 - DNA, 19 bp, Homo sapiens
tttaagaataaaagtaaaa

SEQ ID NO: 85323 - DNA, 25 bp, Homo sapiens
tctaagaatttattctaaaatattt

SEQ ID NO: 85324 - DNA, 22 bp, Homo sapiens
aagaatgaaaatgcccatattt

SEQ ID NO: 85325 - DNA, 21 bp, Homo sapiens
tttaaaaatgaaaatgaaaac

SEQ ID NO: 85326 - DNA, 19 bp, Homo sapiens
tttagaaatgaaaataaaa

SEQ ID NO: 85327 - DNA, 67 bp, Tupaia herpesvirus
aatcgttctcacacgttcgaattaccgacacacatctgtcggctataggacttgctgcacaacggtt

SEQ ID NO: 85328 - DNA, 24 bp, Tupaia herpesvirus
cacacgttcgaattaccgacacac

SEQ ID NO: 85329 - DNA, 22 bp, Homo sapiens
cacacattcacccccggtacac

SEQ ID NO: 85330 - DNA, 21 bp, Homo sapiens
cacacatttgaatgttacaca

SEQ ID NO: 85331 - DNA, 20 bp, Homo sapiens
acatgtttgaattacctcac

SEQ ID NO: 85332 - DNA, 20 bp, Homo sapiens
caggttcgaatcttccatac

SEQ ID NO: 85333 - DNA, 20 bp, Homo sapiens
acatgttcaaattgcctaac

SEQ ID NO: 85334 - DNA, 17 bp, Homo sapiens
ttccataaccgacacac

SEQ ID NO: 85335 - DNA, 66 bp, Human adenovirus F
tgcatcggtgccgtaaccttcgctgctttacttaaaaagcctgtgatttcatttaccaccccagca

SEQ ID NO: 85336 - DNA, 24 bp, Human adenovirus F
tcggtgccgtaaccttcgctgctt

SEQ ID NO: 85337 - DNA, 22 bp, Homo sapiens
tcggtgcttacatacgctgctt

SEQ ID NO: 85338 - DNA, 19 bp, Homo sapiens
tcggtgcctgaccgccgct

SEQ ID NO: 85339 - DNA, 18 bp, Homo sapiens
tcggtctcgctcgctgct

SEQ ID NO: 85340 - DNA, 69 bp, Human parainfluenza virus 3
tacaataaagatatatcttaacctttatctttgagcccaaggatagacaaaaagtaagaaaaacatgta

SEQ ID NO: 85341 - DNA, 24 bp, Human parainfluenza virus 3
tatcttaacctttatctttgagcc

SEQ ID NO: 85342 - DNA, 16 bp, Homo sapiens
cttaacctccttgagc

SEQ ID NO: 85343 - DNA, 23 bp, Homo sapiens
tcccttccttttatctttgagcc

SEQ ID NO: 85344 - DNA, 19 bp, Homo sapiens
tatcttagccttggaaagc

SEQ ID NO: 85345 - DNA, 16 bp, Homo sapiens
cttaacctttctgagc

SEQ ID NO: 85346 - DNA, 19 bp, Homo sapiens
cttggcttctctttgagcc

SEQ ID NO: 85347 - DNA, 23 bp, Homo sapiens
tcttaacctttgaaagtagagcc

SEQ ID NO: 85348 - DNA, 15 bp, Homo sapiens
cttaacctctttgag

SEQ ID NO: 85349 - DNA, 23 bp, Homo sapiens
tatcctgaaggtatttttgagcc

SEQ ID NO: 85350 - DNA, 21 bp, Homo sapiens
tcttaattcttcttttgagcc

SEQ ID NO: 85351 - DNA, 22 bp, Homo sapiens
tatcataacctttgggaaaagc

SEQ ID NO: 85352 - DNA, 21 bp, Homo sapiens
tatctttgtttttcatgagcc

SEQ ID NO: 85353 - DNA, 24 bp, Homo sapiens
tatcttcagtttaaccctttgagc

SEQ ID NO: 85354 - DNA, 96 bp, Ateline herpesvirus 3
aggagtaaagttgttgcttcaagaatgtttcatacaactgaagagtggttctgtagttgctatttatgtattctaagaaaagtccaacccacttct

SEQ ID NO: 85355 - DNA, 24 bp, Ateline herpesvirus 3
aagaatgtttcatacaactgaaga

SEQ ID NO: 85356 - DNA, 20 bp, Homo sapiens
aagctctcctcatacagctg

SEQ ID NO: 85357 - DNA, 20 bp, Homo sapiens
aaaaatgtgtacagctgaag

SEQ ID NO: 85358 - DNA, 19 bp, Homo sapiens
aaatgtttcaggcctggag

SEQ ID NO: 85359 - DNA, 23 bp, Homo sapiens
agaattactcttacaactgaaga

SEQ ID NO: 85360 - DNA, 27 bp, Homo sapiens
aagaatgtacacatgtacagttgagga

SEQ ID NO: 85361 - DNA, 16 bp, Homo sapiens
gaatgtttcattctga

SEQ ID NO: 85362 - DNA, 23 bp, Homo sapiens
aagaggctccatacaactggaga

SEQ ID NO: 85363 - DNA, 17 bp, Homo sapiens
gaattttcatacaatga

SEQ ID NO: 85364 - DNA, 21 bp, Homo sapiens
gaatgcttcagtcactggaga

SEQ ID NO: 85365 - DNA, 17 bp, Homo sapiens
aaatgtttcatatgaaa

SEQ ID NO: 85366 - DNA, 22 bp, Homo sapiens
aagattgtttcatagcacaaga

SEQ ID NO: 85367 - DNA, 17 bp, Homo sapiens
gaatgccatgactgaag

SEQ ID NO: 85368 - DNA, 27 bp, Homo sapiens
aagggtgtcagaggatacaactggaga

SEQ ID NO: 85369 - DNA, 22 bp, Homo sapiens
aagaatgtgtctttattgaaga

SEQ ID NO: 85370 - DNA, 21 bp, Homo sapiens
aaaaatgggacataactgaag

SEQ ID NO: 85371 - DNA, 24 bp, Homo sapiens
ggaaatgtttcatataaaacactg

SEQ ID NO: 85372 - DNA, 21 bp, Homo sapiens
agactgtttcataaaaaaaga

SEQ ID NO: 85373 - DNA, 18 bp, Homo sapiens
agagtgttgaaactgaag

SEQ ID NO: 85374 - DNA, 23 bp, Homo sapiens
agatgtttcatatgcactcgaga

SEQ ID NO: 85375 - DNA, 21 bp, Homo sapiens
aagagagtttacaactgaaga

SEQ ID NO: 85376 - DNA, 20 bp, Homo sapiens
aagactgcagataactgaag

SEQ ID NO: 85377 - DNA, 22 bp, Homo sapiens
gagtgcttcaagaaactgaaga

SEQ ID NO: 85378 - DNA, 23 bp, Homo sapiens
aagggtgctgcagtaactgaaga

SEQ ID NO: 85379 - DNA, 18 bp, Homo sapiens
aagaagatacaactgaag

SEQ ID NO: 85380 - DNA, 18 bp, Homo sapiens
gaatgtttccctctgaag

SEQ ID NO: 85381 - DNA, 20 bp, Homo sapiens
aatggagagacaactgaaga

SEQ ID NO: 85382 - DNA, 17 bp, Homo sapiens
gaatgtttcatgcactg

SEQ ID NO: 85383 - DNA, 21 bp, Homo sapiens
agaatgttcagggcctggaga

SEQ ID NO: 85384 - DNA, 21 bp, Homo sapiens
agaatgtttcattgttactga

SEQ ID NO: 85385 - DNA, 111 bp, Mice minute virus
ttttagaactgaccaaccatgttcacgtaagtgacgtgatgacgcgcgctgcgcgcgcgccttcggacgtcacacgtcacttacgtttcacatggttggtcagttctaaaa

SEQ ID NO: 85386 - DNA, 24 bp, Mice minute virus
gaactgaccaaccatgttcacgta

SEQ ID NO: 85387 - DNA, 21 bp, Homo sapiens
ctgacagccacagcccatgta

SEQ ID NO: 85388 - DNA, 21 bp, Homo sapiens
ctggctaaacccctccacgta

SEQ ID NO: 85389 - DNA, 19 bp, Homo sapiens
gagctgaccaagcacacgt

SEQ ID NO: 85390 - DNA, 21 bp, Homo sapiens
gactgaccaatcacaacacgt

SEQ ID NO: 85391 - DNA, 23 bp, Homo sapiens
gaactgacggccatccccgcgta

SEQ ID NO: 85392 - DNA, 18 bp, Homo sapiens
ctgactgcatgttcatgt

SEQ ID NO: 85393 - DNA, 22 bp, Homo sapiens
gaactgccatcatgttcacgta

SEQ ID NO: 85394 - DNA, 24 bp, Homo sapiens
gaactgactgcttgcttggcacgt

SEQ ID NO: 85395 - DNA, 61 bp, Bovine adenovirus D
tggatctttacaaatagaaggatctatttttgttacattttctttccattgtaaagcttca

SEQ ID NO: 85396 - DNA, 17 bp, Bovine adenovirus D
tccattgtaaagcttca

SEQ ID NO: 85397 - DNA, 20 bp, Homo sapiens
tccgttaactgtgagcttca

SEQ ID NO: 85398 - DNA, 18 bp, Homo sapiens
tccattgctaaagcctca

SEQ ID NO: 85399 - DNA, 19 bp, Homo sapiens
tccactgcttaaggcttca

SEQ ID NO: 85400 - DNA, 20 bp, Homo sapiens
cccattgtgtcccagcttca

SEQ ID NO: 85401 - DNA, 19 bp, Homo sapiens
ccattgcactatagcttca

SEQ ID NO: 85402 - DNA, 63 bp, Cowpox virus
aaaatcgattccgtccaagatgataaaaacatttaccggcatcataaacacggagtttatttt

SEQ ID NO: 85403 - DNA, 24 bp, Cowpox virus
tcgattccgtccaagatgataaaa

SEQ ID NO: 85404 - DNA, 22 bp, Homo sapiens
tcgattccgtttcatcccgaga

SEQ ID NO: 85405 - DNA, 20 bp, Homo sapiens
tcattccgtctgcaaggtaa

SEQ ID NO: 85406 - DNA, 18 bp, Homo sapiens
tcgattccgtttgagtga

SEQ ID NO: 85407 - DNA, 17 bp, Homo sapiens
ccgattccgtcccagtg

SEQ ID NO: 85408 - DNA, 78 bp, Fowl adenovirus D
ggcattaaatcgtatctatcggattaccaaaaatttagcatgtcgccgtttttttaggtcgatccgccgtcggctgcc

SEQ ID NO: 85409 - DNA, 24 bp, Fowl adenovirus D
tctatcggattaccaaaaatttag

SEQ ID NO: 85410 - DNA, 23 bp, Homo sapiens
ctataattgcaccaaaaatttag

SEQ ID NO: 85411 - DNA, 68 bp, Bovine herpesvirus 1
cggggggaacaatgacgcaaaagggccccgggcgctgagttaaatccggcgcctactcgcgccgcccg

SEQ ID NO: 85412 - DNA, 22 bp, Bovine herpesvirus 1
cggcgcctactcgcgccgcccg

SEQ ID NO: 85413 - DNA, 18 bp, Homo sapiens
gcctaaccacgccgcccg

SEQ ID NO: 85414 - DNA, 16 bp, Homo sapiens
cgcgcgcccgccgccc

SEQ ID NO: 85415 - DNA, 21 bp, Homo sapiens
gcgcccgggccgcgccgcccg

SEQ ID NO: 85416 - DNA, 21 bp, Homo sapiens
cggagcagcccgcgccgcccg

SEQ ID NO: 85417 - DNA, 16 bp, Homo sapiens
cgccgccgcgccgccc

SEQ ID NO: 85418 - DNA, 17 bp, Homo sapiens
cgccgcccccgctgccc

SEQ ID NO: 85419 - DNA, 16 bp, Homo sapiens
cgccgcctgcgccgcc

SEQ ID NO: 85420 - DNA, 19 bp, Homo sapiens
gcgccgccgccgccgcccg

SEQ ID NO: 85421 - DNA, 18 bp, Homo sapiens
gctgctccccgccgcccg

SEQ ID NO: 85422 - DNA, 18 bp, Homo sapiens
ggcgctcgccgccgcccg

SEQ ID NO: 85423 - DNA, 17 bp, Homo sapiens
gcgctcctcgccgcccg

SEQ ID NO: 85424 - DNA, 20 bp, Homo sapiens
cgccgcccgcccgccgcccg

SEQ ID NO: 85425 - DNA, 19 bp, Homo sapiens
cagcgcctactcaggcccc

SEQ ID NO: 85426 - DNA, 19 bp, Homo sapiens
cgggtcccagcgccgcccg

SEQ ID NO: 85427 - DNA, 19 bp, Homo sapiens
cggcgctcacgcccgcccg

SEQ ID NO: 85428 - DNA, 19 bp, Homo sapiens
cggccgccgccgccgcccg

SEQ ID NO: 85429 - DNA, 21 bp, Homo sapiens
cgggccgagcagcgccgcccg

SEQ ID NO: 85430 - DNA, 16 bp, Homo sapiens
cggtccctcagccgcc

SEQ ID NO: 85431 - DNA, 15 bp, Homo sapiens
agcgccacgccgccc

SEQ ID NO: 85432 - DNA, 18 bp, Homo sapiens
ggcgcggcgcgccgcccg

SEQ ID NO: 85433 - DNA, 16 bp, Homo sapiens
cggcgcccgcccgtcc

SEQ ID NO: 85434 - DNA, 21 bp, Homo sapiens
cggccccgccgccgccgcccg

SEQ ID NO: 85435 - DNA, 17 bp, Homo sapiens
cgccgccgccgccgccc

SEQ ID NO: 85436 - DNA, 19 bp, Homo sapiens
ggctcccgcccgccgcccg

SEQ ID NO: 85437 - DNA, 21 bp, Homo sapiens
cggcgccgccgccgccgcccg

SEQ ID NO: 85438 - DNA, 21 bp, Homo sapiens
ggtcccgcgcgccgctgcccg

SEQ ID NO: 85439 - DNA, 20 bp, Homo sapiens
cgccggctccgcgccgcccg

SEQ ID NO: 85440 - DNA, 21 bp, Homo sapiens
cgccgccgccgctgccgcccg

SEQ ID NO: 85441 - DNA, 26 bp, Homo sapiens
cggcgcctccgtggccgcgccgctcg

SEQ ID NO: 85442 - DNA, 22 bp, Homo sapiens
cgggccggctccgcgccgctcg

SEQ ID NO: 85443 - DNA, 17 bp, Homo sapiens
cggcgccttctcggccg

SEQ ID NO: 85444 - DNA, 17 bp, Homo sapiens
cggcgcctgctgcgtgc

SEQ ID NO: 85445 - DNA, 21 bp, Homo sapiens
gcctcttcgcgccgctgcccg

SEQ ID NO: 85446 - DNA, 20 bp, Homo sapiens
cagcgcctggctcccgcccg

SEQ ID NO: 85447 - DNA, 26 bp, Homo sapiens
cggcgcctggctcgtgtccccacgcc

SEQ ID NO: 85448 - DNA, 16 bp, Homo sapiens
cggcgctcggctgccc

SEQ ID NO: 85449 - DNA, 21 bp, Homo sapiens
cgccgctgccgacgccgcccg

SEQ ID NO: 85450 - DNA, 22 bp, Homo sapiens
cgcgcgccctacgcgccgctcg

SEQ ID NO: 85451 - DNA, 20 bp, Homo sapiens
gcgcctgctcccgccgcccg

SEQ ID NO: 85452 - DNA, 20 bp, Homo sapiens
gcgcaccgcggtgccgcccg

SEQ ID NO: 85453 - DNA, 19 bp, Homo sapiens
cgggccccgccgccgcccg

SEQ ID NO: 85454 - DNA, 20 bp, Homo sapiens
cggcgtctcctcggaagccg

SEQ ID NO: 85455 - DNA, 19 bp, Homo sapiens
gcgccgcagctgccgcccg

SEQ ID NO: 85456 - DNA, 15 bp, Homo sapiens
cagcgccccgccgcc

SEQ ID NO: 85457 - DNA, 16 bp, Homo sapiens
cggcccggcgccgccc

SEQ ID NO: 85458 - DNA, 22 bp, Homo sapiens
cggcgcccgctccgaaggctcg

SEQ ID NO: 85459 - DNA, 20 bp, Homo sapiens
cggcccctgggctccgtccg

SEQ ID NO: 85460 - DNA, 18 bp, Homo sapiens
gctgcctactccccctcg

SEQ ID NO: 85461 - DNA, 22 bp, Homo sapiens
cggcgcctaccgcgtagacccg

SEQ ID NO: 85462 - DNA, 20 bp, Homo sapiens
cgccgcttccgcgccgcccg

SEQ ID NO: 85463 - DNA, 22 bp, Homo sapiens
cggcgcctgctcagtctgtccg

SEQ ID NO: 85464 - DNA, 19 bp, Homo sapiens
gcctccctcgcgccgcccg

SEQ ID NO: 85465 - DNA, 21 bp, Homo sapiens
cggcgcccgctcccagtcccg

SEQ ID NO: 85466 - DNA, 17 bp, Homo sapiens
cggcgcccgccttgccc

SEQ ID NO: 85467 - DNA, 24 bp, Homo sapiens
cgccgccccgccgcgcgtcgctcg

SEQ ID NO: 85468 - DNA, 16 bp, Homo sapiens
cgggcctcggccgccc

SEQ ID NO: 85469 - DNA, 19 bp, Homo sapiens
cggcgcctcctcgccgccc

SEQ ID NO: 85470 - DNA, 20 bp, Homo sapiens
gctgcgtactgcgccgcccg

SEQ ID NO: 85471 - DNA, 19 bp, Homo sapiens
gcgttttctacgccgcccg

SEQ ID NO: 85472 - DNA, 21 bp, Homo sapiens
cgccgtcctaggcgccgcccg

SEQ ID NO: 85473 - DNA, 17 bp, Homo sapiens
cggctcctctgccgccc

SEQ ID NO: 85474 - DNA, 17 bp, Homo sapiens
cgccgctcccgccgccc

SEQ ID NO: 85475 - DNA, 21 bp, Homo sapiens
cgacgccgccgctgttgcccg

SEQ ID NO: 85476 - DNA, 18 bp, Homo sapiens
gcgcctctgcgccgcccg

SEQ ID NO: 85477 - DNA, 19 bp, Homo sapiens
gcgccgtcgccgccgtccg

SEQ ID NO: 85478 - DNA, 20 bp, Homo sapiens
gctccgcctcgcgccgcccg

SEQ ID NO: 85479 - DNA, 19 bp, Homo sapiens
cgggcctgctcgccgcccg

SEQ ID NO: 85480 - DNA, 19 bp, Homo sapiens
gccgctgcgccgccgcccg

SEQ ID NO: 85481 - DNA, 22 bp, Homo sapiens
gctgcctactcgcagggctccg

SEQ ID NO: 85482 - DNA, 21 bp, Homo sapiens
cggcggccagggcgccgcccg

SEQ ID NO: 85483 - DNA, 21 bp, Homo sapiens
cgccgcctccgccgccgcccg

SEQ ID NO: 85484 - DNA, 20 bp, Homo sapiens
cggcggtcggctgccgcccg

SEQ ID NO: 85485 - DNA, 19 bp, Homo sapiens
gcgccgtccgcgccgttcg

SEQ ID NO: 85486 - DNA, 18 bp, Homo sapiens
ggcgtccactcacacgcc

SEQ ID NO: 85487 - DNA, 21 bp, Homo sapiens
cgccgccgccgccgccgcccg

SEQ ID NO: 85488 - DNA, 18 bp, Homo sapiens
ggcgccgccgccgccgcc

SEQ ID NO: 85489 - DNA, 19 bp, Homo sapiens
cggctccgcgcgccgcccg

SEQ ID NO: 85490 - DNA, 16 bp, Homo sapiens
cggcgcctgtcacccg

SEQ ID NO: 85491 - DNA, 22 bp, Homo sapiens
cgccgcctgctcccggcgcccg

SEQ ID NO: 85492 - DNA, 23 bp, Homo sapiens
cagcgcctggctcccgtgctgcc

SEQ ID NO: 85493 - DNA, 18 bp, Homo sapiens
cggcgtctcagccgcccg

SEQ ID NO: 85494 - DNA, 18 bp, Homo sapiens
cgcctagctcgccgcccg

SEQ ID NO: 85495 - DNA, 19 bp, Homo sapiens
cgggccgcgccgccgcccg

SEQ ID NO: 85496 - DNA, 17 bp, Homo sapiens
cgccgtctcgccgcccg

SEQ ID NO: 85497 - DNA, 19 bp, Homo sapiens
cgccgcccagcgctgcccg

SEQ ID NO: 85498 - DNA, 17 bp, Homo sapiens
cggcgcactggccgccc

SEQ ID NO: 85499 - DNA, 16 bp, Homo sapiens
cggcgcccgcccgccc

SEQ ID NO: 85500 - DNA, 19 bp, Homo sapiens
cgccgcctccggccgcccg

SEQ ID NO: 85501 - DNA, 19 bp, Homo sapiens
cgccgcttgcgcgcgcccg

SEQ ID NO: 85502 - DNA, 17 bp, Homo sapiens
ggcgcccacttcctgcc

SEQ ID NO: 85503 - DNA, 17 bp, Homo sapiens
cgccgcctactcctccc

SEQ ID NO: 85504 - DNA, 17 bp, Homo sapiens
cggcctcggcgccgccc

SEQ ID NO: 85505 - DNA, 20 bp, Homo sapiens
cgcgcgccgcccgccgcccg

SEQ ID NO: 85506 - DNA, 20 bp, Homo sapiens
gcgcgcgcgcgcgccgcccg

SEQ ID NO: 85507 - DNA, 19 bp, Homo sapiens
ggcccctcacagctgtccg

SEQ ID NO: 85508 - DNA, 17 bp, Homo sapiens
cgccgcctccgccgccc

SEQ ID NO: 85509 - DNA, 20 bp, Homo sapiens
ggcgtccggagcgccgcccg

SEQ ID NO: 85510 - DNA, 23 bp, Homo sapiens
cgtgccgccacccgcgccgcccg

SEQ ID NO: 85511 - DNA, 15 bp, Homo sapiens
cggcgcctgccgccc

SEQ ID NO: 85512 - DNA, 18 bp, Homo sapiens
gcgcgccgccgctgcccg

SEQ ID NO: 85513 - DNA, 17 bp, Homo sapiens
gcgccgcccgccgcccg

SEQ ID NO: 85514 - DNA, 21 bp, Homo sapiens
cggcgccttgcgtcacgtccg

SEQ ID NO: 85515 - DNA, 15 bp, Homo sapiens
gggcccacgccgccc

SEQ ID NO: 85516 - DNA, 18 bp, Homo sapiens
ggcgcggggcgccgcccg

SEQ ID NO: 85517 - DNA, 15 bp, Homo sapiens
cggcgtccgccgccc

SEQ ID NO: 85518 - DNA, 19 bp, Homo sapiens
cgccgcctcccgccgcccg

SEQ ID NO: 85519 - DNA, 19 bp, Homo sapiens
cggcgcccgcgcccgctcg

SEQ ID NO: 85520 - DNA, 19 bp, Homo sapiens
cgggcctggaggccgcccg

SEQ ID NO: 85521 - DNA, 16 bp, Homo sapiens
cagcgcctccgccgcc

SEQ ID NO: 85522 - DNA, 17 bp, Homo sapiens
cggcgcccgctcgcccg

SEQ ID NO: 85523 - DNA, 18 bp, Homo sapiens
cggcgccgcggcaccgcc

SEQ ID NO: 85524 - DNA, 20 bp, Homo sapiens
cgtcgcttcccggccgcccg

SEQ ID NO: 85525 - DNA, 19 bp, Homo sapiens
gcgcgcggcgcgccgcccg

SEQ ID NO: 85526 - DNA, 20 bp, Homo sapiens
cggcgcttgactgccgcccg

SEQ ID NO: 85527 - DNA, 18 bp, Homo sapiens
cggcgcctctcgggacac

SEQ ID NO: 85528 - DNA, 21 bp, Homo sapiens
cgccgctccggccgccgcccg

SEQ ID NO: 85529 - DNA, 20 bp, Homo sapiens
cggcccgaagccgccgcccg

SEQ ID NO: 85530 - DNA, 19 bp, Homo sapiens
cggcccccgccgccgcccg

SEQ ID NO: 85531 - DNA, 18 bp, Homo sapiens
cggcgcctgctcccggcc

SEQ ID NO: 85532 - DNA, 19 bp, Homo sapiens
cgccgttccccgccgcccg

SEQ ID NO: 85533 - DNA, 19 bp, Homo sapiens
ggcgccgccgcgctgcccg

SEQ ID NO: 85534 - DNA, 20 bp, Homo sapiens
gcgcccactcgcgccgcccg

SEQ ID NO: 85535 - DNA, 17 bp, Homo sapiens
cggcgctccggccgccc

SEQ ID NO: 85536 - DNA, 19 bp, Homo sapiens
cggccgcccgcgccgctcg

SEQ ID NO: 85537 - DNA, 20 bp, Homo sapiens
cggcgccctactgtgctgcc

SEQ ID NO: 85538 - DNA, 18 bp, Homo sapiens
gcgcgctcccgccgcccg

SEQ ID NO: 85539 - DNA, 21 bp, Homo sapiens
ggcgctggccagtgccgcccg

SEQ ID NO: 85540 - DNA, 22 bp, Homo sapiens
cggcatggcgacgcgccgctcg

SEQ ID NO: 85541 - DNA, 18 bp, Homo sapiens
gcgttagcccgccgcccg

SEQ ID NO: 85542 - DNA, 19 bp, Homo sapiens
cggcggcctcggccgcccg

SEQ ID NO: 85543 - DNA, 22 bp, Homo sapiens
ggtgcctacccctcactgtccg

SEQ ID NO: 85544 - DNA, 18 bp, Homo sapiens
cgggctccgcgccgctcg

SEQ ID NO: 85545 - DNA, 20 bp, Homo sapiens
cagcgccccctcgccgcccg

SEQ ID NO: 85546 - DNA, 21 bp, Homo sapiens
gcgcgctcgggccgctgcccg

SEQ ID NO: 85547 - DNA, 17 bp, Homo sapiens
cggcgcccgcgcgctcg

SEQ ID NO: 85548 - DNA, 19 bp, Homo sapiens
cagcgcctgtgcccgctcg

SEQ ID NO: 85549 - DNA, 18 bp, Homo sapiens
ggtgcccctcgccgcccg

SEQ ID NO: 85550 - DNA, 20 bp, Homo sapiens
cggcgcctcggggcgccgcc

SEQ ID NO: 85551 - DNA, 16 bp, Homo sapiens
cgccgctccgccgccc

SEQ ID NO: 85552 - DNA, 18 bp, Homo sapiens
gcgcgcccccgccgcccg

SEQ ID NO: 85553 - DNA, 18 bp, Homo sapiens
cggcgcctgtccgcgagc

SEQ ID NO: 85554 - DNA, 22 bp, Homo sapiens
cggtcgccgcagtcgccgcccg

SEQ ID NO: 85555 - DNA, 19 bp, Homo sapiens
gcgccccgcgcgctgcccg

SEQ ID NO: 85556 - DNA, 16 bp, Homo sapiens
ggcgcgcccgccgccc

SEQ ID NO: 85557 - DNA, 18 bp, Homo sapiens
gcgcccgcccgccgcccg

SEQ ID NO: 85558 - DNA, 18 bp, Homo sapiens
gcctgtccgcgccgcccg

SEQ ID NO: 85559 - DNA, 19 bp, Homo sapiens
cggctgtccgcgccgcccg

SEQ ID NO: 85560 - DNA, 17 bp, Homo sapiens
cagcgctaccgccgccc

SEQ ID NO: 85561 - DNA, 20 bp, Homo sapiens
cgtcgccttgccgccgcccg

SEQ ID NO: 85562 - DNA, 20 bp, Homo sapiens
cgccgccgccctgctgcccg

SEQ ID NO: 85563 - DNA, 18 bp, Homo sapiens
cgccgccgccgccgcccg

SEQ ID NO: 85564 - DNA, 16 bp, Homo sapiens
gcgcacccgcgccgcc

SEQ ID NO: 85565 - DNA, 19 bp, Homo sapiens
cggccgcccccgccgcccg

SEQ ID NO: 85566 - DNA, 70 bp, Molluscum contagiosum virus
ggcccgaaaacctgcgcgccgcggcggcaaaagtgaaaaagtactggctcctggtgttgcgcgccgggcc

SEQ ID NO: 85567 - DNA, 24 bp, Molluscum contagiosum virus
ctggctcctggtgttgcgcgccgg

SEQ ID NO: 85568 - DNA, 22 bp, Homo sapiens
ctggcttctgcgcacgcgccgg

SEQ ID NO: 85569 - DNA, 15 bp, Homo sapiens
ctggctctgcgcgcc

SEQ ID NO: 85570 - DNA, 22 bp, Homo sapiens
ctggccctggcgcttgtgtcgg

SEQ ID NO: 85571 - DNA, 17 bp, Homo sapiens
ctggctcctgtgtcagc

SEQ ID NO: 85572 - DNA, 23 bp, Homo sapiens
ctggctcctggctgaggggctgg

SEQ ID NO: 85573 - DNA, 18 bp, Homo sapiens
ggctcctgctggctgcgc

SEQ ID NO: 85574 - DNA, 27 bp, Homo sapiens
ctggctcctgtgtgctcaaggtgctgg

SEQ ID NO: 85575 - DNA, 22 bp, Homo sapiens
ctggctgctgctgctgcgccgg

SEQ ID NO: 85576 - DNA, 21 bp, Homo sapiens
cgttcctggtgcccaggctgg

SEQ ID NO: 85577 - DNA, 15 bp, Homo sapiens
tggcccctgttgcgc

SEQ ID NO: 85578 - DNA, 22 bp, Homo sapiens
ctggctgctggtgctttgctgg

SEQ ID NO: 85579 - DNA, 20 bp, Homo sapiens
ctggctcctgagccctgcgc

SEQ ID NO: 85580 - DNA, 21 bp, Homo sapiens
ctggctcctgggtggcactgg

SEQ ID NO: 85581 - DNA, 70 bp, Human herpesvirus 2
gggggcgagccaccgtcccgcccgccagtgcatcccagacgcccgcgagccgcacatcccctccgctccc

SEQ ID NO: 85582 - DNA, 24 bp, Human herpesvirus 2
cccgcgagccgcacatcccctccg

SEQ ID NO: 85583 - DNA, 20 bp, Homo sapiens
cctgccctttgcatcccctc

SEQ ID NO: 85584 - DNA, 20 bp, Homo sapiens
ccgcggccggagcccctccg

SEQ ID NO: 85585 - DNA, 21 bp, Homo sapiens
ccccgggcccccgcccctccg

SEQ ID NO: 85586 - DNA, 24 bp, Homo sapiens
cctccgagccgccggtcctctccg

SEQ ID NO: 85587 - DNA, 18 bp, Homo sapiens
cccgcgagtcgcgccgcc

SEQ ID NO: 85588 - DNA, 22 bp, Homo sapiens
gcgagttgccgagtcccctccg

SEQ ID NO: 85589 - DNA, 21 bp, Homo sapiens
ccgcgagccgcggagccgcct

SEQ ID NO: 85590 - DNA, 22 bp, Homo sapiens
cccgcgagctcgcctcgcctcc

SEQ ID NO: 85591 - DNA, 18 bp, Homo sapiens
gcgcgccggccccctccg

SEQ ID NO: 85592 - DNA, 21 bp, Homo sapiens
ccgcgggtctccacccctccg

SEQ ID NO: 85593 - DNA, 21 bp, Homo sapiens
ccgccggccgcacaaagactc

SEQ ID NO: 85594 - DNA, 19 bp, Homo sapiens
ccggcgagctcgcccctcc

SEQ ID NO: 85595 - DNA, 20 bp, Homo sapiens
ccgcgacgcggtcccctccg

SEQ ID NO: 85596 - DNA, 18 bp, Homo sapiens
cccgcgaagcccccctcc

SEQ ID NO: 85597 - DNA, 19 bp, Homo sapiens
ccccgggccctaccccctc

SEQ ID NO: 85598 - DNA, 18 bp, Homo sapiens
cccggagctgcatcccct

SEQ ID NO: 85599 - DNA, 18 bp, Homo sapiens
cggagctccactccctct

SEQ ID NO: 85600 - DNA, 21 bp, Homo sapiens
cccgagccgccgccgcctccg

SEQ ID NO: 85601 - DNA, 17 bp, Homo sapiens
cccgagccgccgcctcc

SEQ ID NO: 85602 - DNA, 21 bp, Homo sapiens
ccgggactagcgtcccctccg

SEQ ID NO: 85603 - DNA, 21 bp, Homo sapiens
ccgcgactagcgtcccctccg

SEQ ID NO: 85604 - DNA, 20 bp, Homo sapiens
ccgggctccgctcccctccg

SEQ ID NO: 85605 - DNA, 17 bp, Homo sapiens
ccgcggccgccccctcc

SEQ ID NO: 85606 - DNA, 21 bp, Homo sapiens
cccttggccacgtcccctccg

SEQ ID NO: 85607 - DNA, 18 bp, Homo sapiens
cctgcgagccgcccaccc

SEQ ID NO: 85608 - DNA, 20 bp, Homo sapiens
ccagcgccgcgtcccctccg

SEQ ID NO: 85609 - DNA, 18 bp, Homo sapiens
ccgcgagccaccccctcc

SEQ ID NO: 85610 - DNA, 21 bp, Homo sapiens
cccacgagccgcacgtcatct

SEQ ID NO: 85611 - DNA, 18 bp, Homo sapiens
cccgcgagcccgcccctc

SEQ ID NO: 85612 - DNA, 18 bp, Homo sapiens
cccgcggccgccccctcc

SEQ ID NO: 85613 - DNA, 22 bp, Homo sapiens
cccgcgaggtgcgctcactccg

SEQ ID NO: 85614 - DNA, 20 bp, Homo sapiens
cccaccctgcacatcccttc

SEQ ID NO: 85615 - DNA, 18 bp, Homo sapiens
cccgggctcatcccctcc

SEQ ID NO: 85616 - DNA, 20 bp, Homo sapiens
cccgcagcgcgtcccctccg

SEQ ID NO: 85617 - DNA, 23 bp, Homo sapiens
ccgcgagcctagggtctcctccg

SEQ ID NO: 85618 - DNA, 16 bp, Homo sapiens
cctgcagccgcacctc

SEQ ID NO: 85619 - DNA, 22 bp, Homo sapiens
cctgctagccccttcccctccg

SEQ ID NO: 85620 - DNA, 18 bp, Homo sapiens
cctggagccagcccctcc

SEQ ID NO: 85621 - DNA, 19 bp, Homo sapiens
cggagtggcctcccctccg

SEQ ID NO: 85622 - DNA, 17 bp, Homo sapiens
gcttccgctcccctccg

SEQ ID NO: 85623 - DNA, 20 bp, Homo sapiens
cctgcgagccgaactcctct

SEQ ID NO: 85624 - DNA, 18 bp, Homo sapiens
ccccgagctgaccccctc

SEQ ID NO: 85625 - DNA, 22 bp, Homo sapiens
ccggtcctgcgtgtcccctccg

SEQ ID NO: 85626 - DNA, 24 bp, Homo sapiens
cccacgagccgcgcgtcgccttcg

SEQ ID NO: 85627 - DNA, 21 bp, Homo sapiens
cccgcgagccggggggctccg

SEQ ID NO: 85628 - DNA, 101 bp, Sheeppox virus
tttataattagatttaaattggcttcaattagacttaaaagattgaatgaaaaaagtatccatttacaggtttaattggcttttttataattagatttaaa

SEQ ID NO: 85629 - DNA, 24 bp, Sheeppox virus
tacaggtttaattggcttttttat

SEQ ID NO: 85630 - DNA, 20 bp, Homo sapiens
aggtttaatttcatttttat

SEQ ID NO: 85631 - DNA, 19 bp, Homo sapiens
tacaggtttattggctcct

SEQ ID NO: 85632 - DNA, 19 bp, Homo sapiens
tacaggttgaattagtttt

SEQ ID NO: 85633 - DNA, 18 bp, Homo sapiens
agatttaagcctttttat

SEQ ID NO: 85634 - DNA, 17 bp, Homo sapiens
acaggtttactttttta

SEQ ID NO: 85635 - DNA, 22 bp, Homo sapiens
tacagatttgatcaatcttttt

SEQ ID NO: 85636 - DNA, 19 bp, Homo sapiens
cagatttatggactttttt

SEQ ID NO: 85637 - DNA, 17 bp, Homo sapiens
ggcctcttggctttttt

SEQ ID NO: 85638 - DNA, 76 bp, Rat cytomegalovirus
ggcgagcggcgagggcgacactgctggcgcgaggggacccgccgggctcccgcggtccgcccggtccccgctcccc

SEQ ID NO: 85639 - DNA, 24 bp, Rat cytomegalovirus
tcccgcggtccgcccggtccccgc

SEQ ID NO: 85640 - DNA, 22 bp, Homo sapiens
tcccgcggtcctccgagcccgc

SEQ ID NO: 85641 - DNA, 20 bp, Homo sapiens
tcccgcagtctgtccgcccg

SEQ ID NO: 85642 - DNA, 24 bp, Homo sapiens
tccagcgcccagccccggtccccg

SEQ ID NO: 85643 - DNA, 17 bp, Homo sapiens
tctcgcggtccccggcc

SEQ ID NO: 85644 - DNA, 25 bp, Homo sapiens
tcctgcggtccatgcgatgccctgc

SEQ ID NO: 85645 - DNA, 19 bp, Homo sapiens
ccgctagctcggtccccgc

SEQ ID NO: 85646 - DNA, 21 bp, Homo sapiens
tcctgcggcccgccgacccgc

SEQ ID NO: 85647 - DNA, 17 bp, Homo sapiens
tcccgcggtcgcccggc

SEQ ID NO: 85648 - DNA, 24 bp, Homo sapiens
cccgcggtctctgggcgtcctcgc

SEQ ID NO: 85649 - DNA, 24 bp, Homo sapiens
tcccgcggctccgtgctcccctgc

SEQ ID NO: 85650 - DNA, 24 bp, Homo sapiens
tcccccggtccgcccgccgagcgc

SEQ ID NO: 85651 - DNA, 18 bp, Homo sapiens
tctccaagccccggtccc

SEQ ID NO: 85652 - DNA, 17 bp, Homo sapiens
cggccagctggtccccg

SEQ ID NO: 85653 - DNA, 21 bp, Homo sapiens
ccgcaaccgcctggtccctgc

SEQ ID NO: 85654 - DNA, 22 bp, Homo sapiens
tctggcgggtgcccggtcttcg

SEQ ID NO: 85655 - DNA, 18 bp, Homo sapiens
tccagcggtccgcccggt

SEQ ID NO: 85656 - DNA, 25 bp, Homo sapiens
ccgcggtccgcccttggagtttcgc

SEQ ID NO: 85657 - DNA, 23 bp, Homo sapiens
tcccgcggctcgcagggccccgc

SEQ ID NO: 85658 - DNA, 21 bp, Homo sapiens
cgggagccgtccggtccctgc

SEQ ID NO: 85659 - DNA, 18 bp, Homo sapiens
tcccgggcgtggtccccg

SEQ ID NO: 85660 - DNA, 20 bp, Homo sapiens
tcccgcagtcttcgaatgtc

SEQ ID NO: 85661 - DNA, 25 bp, Homo sapiens
tcccgcgtccgcccaggccctccgc

SEQ ID NO: 85662 - DNA, 19 bp, Homo sapiens
tccccggtccggcctcccg

SEQ ID NO: 85663 - DNA, 19 bp, Homo sapiens
tcccgcgggccgctgcccg

SEQ ID NO: 85664 - DNA, 21 bp, Homo sapiens
accgtccgtctcggtccccgc

SEQ ID NO: 85665 - DNA, 23 bp, Homo sapiens
cccgcgccggcctcggtcctcgc

SEQ ID NO: 85666 - DNA, 19 bp, Homo sapiens
tccccggtcccggtccccg

SEQ ID NO: 85667 - DNA, 22 bp, Homo sapiens
tcccgcggctgggccaccccgc

SEQ ID NO: 85668 - DNA, 19 bp, Homo sapiens
tcccgcggctgctgccccg

SEQ ID NO: 85669 - DNA, 21 bp, Homo sapiens
tcccgcggccgccggctccgc

SEQ ID NO: 85670 - DNA, 20 bp, Homo sapiens
ccccagggtctcggttcccg

SEQ ID NO: 85671 - DNA, 22 bp, Homo sapiens
tcccgcggcccgcccggcccgc

SEQ ID NO: 85672 - DNA, 27 bp, Homo sapiens
tcccgcggctgccgccgcgcggggacc

SEQ ID NO: 85673 - DNA, 16 bp, Homo sapiens
cccggtcccctccccg

SEQ ID NO: 85674 - DNA, 19 bp, Homo sapiens
tcccgcggcctgcgccccg

SEQ ID NO: 85675 - DNA, 23 bp, Homo sapiens
tcccgcggccgccccatccccgc

SEQ ID NO: 85676 - DNA, 22 bp, Homo sapiens
ccccgcggtccgcccccgagtc

SEQ ID NO: 85677 - DNA, 18 bp, Homo sapiens
tctcgcggtccgtcgccg

SEQ ID NO: 85678 - DNA, 18 bp, Homo sapiens
tcccaggctcggtccccg

SEQ ID NO: 85679 - DNA, 24 bp, Homo sapiens
tcctgggtccgccccacaccccgc

SEQ ID NO: 85680 - DNA, 21 bp, Homo sapiens
tcccacggtctgggctcctgc

SEQ ID NO: 85681 - DNA, 22 bp, Homo sapiens
tcccgcggctgagcagctccgc

SEQ ID NO: 85682 - DNA, 18 bp, Homo sapiens
tccctggtcttcctcccg

SEQ ID NO: 85683 - DNA, 22 bp, Homo sapiens
tccagcggtccaggcttttcgc

SEQ ID NO: 85684 - DNA, 19 bp, Homo sapiens
tcccgcggtcgccgcagtc

SEQ ID NO: 85685 - DNA, 17 bp, Homo sapiens
tcctgcgtccgccccgc

SEQ ID NO: 85686 - DNA, 26 bp, Homo sapiens
cccgcggttcgctgcgcactctccgc

SEQ ID NO: 85687 - DNA, 18 bp, Homo sapiens
tcccgcaggtcgtccccg

SEQ ID NO: 85688 - DNA, 23 bp, Homo sapiens
tcccgcgatctggcccttctcgc

SEQ ID NO: 85689 - DNA, 89 bp, Meleagrid herpesvirus 1
gcaagaccgcgatggcgtgtgttcctcccgagtctcagaccagttttgggtaggggtcgggaggaattgccttagtcacggatcggggt

SEQ ID NO: 85690 - DNA, 22 bp, Meleagrid herpesvirus 1
tgccttagtcacggatcggggt

SEQ ID NO: 85691 - DNA, 19 bp, Homo sapiens
cttgcaaacggatcggggt

SEQ ID NO: 85692 - DNA, 16 bp, Homo sapiens
tgccttaattgagggg

SEQ ID NO: 85693 - DNA, 16 bp, Homo sapiens
tgcttggccatcgggg

SEQ ID NO: 85694 - DNA, 20 bp, Homo sapiens
tgccttagtcatcccagggt

SEQ ID NO: 85695 - DNA, 16 bp, Homo sapiens
ccttaactgatcgggg

SEQ ID NO: 85696 - DNA, 17 bp, Homo sapiens
tgtcttggccaccaggg

SEQ ID NO: 85697 - DNA, 19 bp, Homo sapiens
tgccttggccacggagggc

SEQ ID NO: 85698 - DNA, 19 bp, Homo sapiens
tgccttagtctcccagggt

SEQ ID NO: 85699 - DNA, 18 bp, Homo sapiens
tgccttagtctggctcag

SEQ ID NO: 85700 - DNA, 72 bp, Melanoplus sanguinipes entomopoxvirus
tataatataattttaattttatatatttaataatttttcaatattatataaatatacattaaaaatattata

SEQ ID NO: 85701 - DNA, 24 bp, Melanoplus sanguinipes entomopoxvirus
tttatatatttaataatttttcaa

SEQ ID NO: 85702 - DNA, 20 bp, Homo sapiens
tttatatatttaacaattct

SEQ ID NO: 85703 - DNA, 24 bp, Homo sapiens
tttatacatttctgcatttttcaa

SEQ ID NO: 85704 - DNA, 25 bp, Homo sapiens
tttatacatttcgatgatttttcaa

SEQ ID NO: 85705 - DNA, 27 bp, Homo sapiens
tttatacattaaagaataatttttcaa

SEQ ID NO: 85706 - DNA, 86 bp, Human herpesvirus 5
ggccacgtgcaacgttcacgctgctataagaaggccatgtcccccgtggacgggtctctttgacacgagcgcggcacgccgttgcc

SEQ ID NO: 85707 - DNA, 24 bp, Human herpesvirus 5
acgctgctataagaaggccatgtc

SEQ ID NO: 85708 - DNA, 19 bp, Homo sapiens
tgctataagaaggaaacgt

SEQ ID NO: 85709 - DNA, 22 bp, Homo sapiens
cgttggatcaaggaggccatgt

SEQ ID NO: 85710 - DNA, 20 bp, Homo sapiens
taccaagggaaggccatgtc

SEQ ID NO: 85711 - DNA, 20 bp, Homo sapiens
actgctataattcttatgtc

SEQ ID NO: 85712 - DNA, 21 bp, Homo sapiens
actcgcggggaaggccatgtc

SEQ ID NO: 85713 - DNA, 18 bp, Homo sapiens
cattgctgaaggccatgt

SEQ ID NO: 85714 - DNA, 18 bp, Homo sapiens
gctgctatgagaacgggc

SEQ ID NO: 85715 - DNA, 18 bp, Homo sapiens
gctgctggcaggccatgt

SEQ ID NO: 85716 - DNA, 88 bp, Equine rhinitis A virus
atctttttctggttttgtttttctttgttttcttttaggactgtgttaagttttaatagttaagagtttttaggaattagtttaagat

SEQ ID NO: 85717 - DNA, 24 bp, Equine rhinitis A virus
tttctggttttgtttttctttgtt

SEQ ID NO: 85718 - DNA, 21 bp, Homo sapiens
ttctggttttgtttttttgtt

SEQ ID NO: 85719 - DNA, 20 bp, Homo sapiens
tacttttgtttttttttgtt

SEQ ID NO: 85720 - DNA, 21 bp, Homo sapiens
tggttttgttttttgtttgtt

SEQ ID NO: 85721 - DNA, 18 bp, Homo sapiens
gttttgttttttttttgt

SEQ ID NO: 85722 - DNA, 19 bp, Homo sapiens
tggtttgtttttttttgct

SEQ ID NO: 85723 - DNA, 19 bp, Homo sapiens
tggttttgttattgctgtt

SEQ ID NO: 85724 - DNA, 21 bp, Homo sapiens
tttttggttttgttttccctt

SEQ ID NO: 85725 - DNA, 23 bp, Homo sapiens
tttctggtttttttggttttgtt

SEQ ID NO: 85726 - DNA, 17 bp, Homo sapiens
tggtttttgtctttgtt

SEQ ID NO: 85727 - DNA, 20 bp, Homo sapiens
ttttgttcatgttctttgtt

SEQ ID NO: 85728 - DNA, 20 bp, Homo sapiens
tagttttgtttttctttatt

SEQ ID NO: 85729 - DNA, 24 bp, Homo sapiens
tttctgttttctctcttctttgtt

SEQ ID NO: 85730 - DNA, 24 bp, Homo sapiens
tttccgtttttgtttttttttgtt

SEQ ID NO: 85731 - DNA, 18 bp, Homo sapiens
ggttttgtcttttttgtt

SEQ ID NO: 85732 - DNA, 20 bp, Homo sapiens
tggttttgttttgttttgtt

SEQ ID NO: 85733 - DNA, 20 bp, Homo sapiens
tttctgttttgttttttttt

SEQ ID NO: 85734 - DNA, 25 bp, Homo sapiens
ttctggttttgttgtgtgctttgtt

SEQ ID NO: 85735 - DNA, 17 bp, Homo sapiens
gttttgttttttttgct

SEQ ID NO: 85736 - DNA, 22 bp, Homo sapiens
ttcctggtgatgtttttttgtt

SEQ ID NO: 85737 - DNA, 24 bp, Homo sapiens
tttccggttttttgtttttttgtt

SEQ ID NO: 85738 - DNA, 19 bp, Homo sapiens
gttttgttttttttttgtt

SEQ ID NO: 85739 - DNA, 26 bp, Homo sapiens
tggttttgagaggcttttttttgtta

SEQ ID NO: 85740 - DNA, 71 bp, Chimpanzee cytomegalovirus
gcgtgtctggagcgcggtgcgaccaagagtcttataaggcagagacgcgggtgggcgccggctcgggccgt

SEQ ID NO: 85741 - DNA, 24 bp, Chimpanzee cytomegalovirus
tgtctggagcgcggtgcgaccaag

SEQ ID NO: 85742 - DNA, 20 bp, Homo sapiens
tgtctggaagtgtgtgtcca

SEQ ID NO: 85743 - DNA, 18 bp, Homo sapiens
gtctggagtgcggctccc

SEQ ID NO: 85744 - DNA, 18 bp, Homo sapiens
tgtctggacaccatgacc

SEQ ID NO: 85745 - DNA, 22 bp, Homo sapiens
tgcttggagaactgtgatcaag

SEQ ID NO: 85746 - DNA, 17 bp, Homo sapiens
tgtctggaatgggacca

SEQ ID NO: 85747 - DNA, 22 bp, Homo sapiens
tctggagcgtgtctctaccaag

SEQ ID NO: 85748 - DNA, 19 bp, Homo sapiens
tgctggagcatctggccaa

SEQ ID NO: 85749 - DNA, 21 bp, Homo sapiens
tgtctgcggtgcggtggaaca

SEQ ID NO: 85750 - DNA, 24 bp, Homo sapiens
tgtctggagcgcgctgcgaactcc

SEQ ID NO: 85751 - DNA, 18 bp, Homo sapiens
tgtctggagttggaacca

SEQ ID NO: 85752 - DNA, 20 bp, Homo sapiens
tgtctggactgtggttcacc

SEQ ID NO: 85753 - DNA, 20 bp, Homo sapiens
tgtctggaggggtatgggcc

SEQ ID NO: 85754 - DNA, 18 bp, Homo sapiens
tgtctggagcagtggcca

SEQ ID NO: 85755 - DNA, 19 bp, Homo sapiens
tgcctggagcacccttggc

SEQ ID NO: 85756 - DNA, 84 bp, Swinepox virus
tagatataacgtatatattcattatatttcccatctaataaattatgggtgggaaatctgaatgcgagtgttcgttttttttta

SEQ ID NO: 85757 - DNA, 24 bp, Swinepox virus
tataacgtatatattcattatatt

SEQ ID NO: 85758 - DNA, 26 bp, Homo sapiens
tataatatatatattccatatatatt

SEQ ID NO: 85759 - DNA, 18 bp, Homo sapiens
tataaagtatatatccat

SEQ ID NO: 85760 - DNA, 22 bp, Homo sapiens
tataacatatatatctcatatt

SEQ ID NO: 85761 - DNA, 92 bp, Rice ragged stunt virus
actgtctctatgccgcctactgttgcctggtgggaaagaacggggccttgagtaagccgcgcccattggggtcggggagtgatagagaaggt

SEQ ID NO: 85762 - DNA, 24 bp, Rice ragged stunt virus
tgcctggtgggaaagaacggggcc

SEQ ID NO: 85763 - DNA, 23 bp, Homo sapiens
tgtctggtggagggagggggggc

SEQ ID NO: 85764 - DNA, 19 bp, Homo sapiens
tacctataggggacggggc

SEQ ID NO: 85765 - DNA, 25 bp, Homo sapiens
tgctggtggggaggggaagcagggc

SEQ ID NO: 85766 - DNA, 19 bp, Homo sapiens
tgcctggtggagagcaaag

SEQ ID NO: 85767 - DNA, 22 bp, Homo sapiens
tgcctggtgggacagcttgggc

SEQ ID NO: 85768 - DNA, 17 bp, Homo sapiens
tgcctgatggggtgggg

SEQ ID NO: 85769 - DNA, 17 bp, Homo sapiens
gcctggtggggaagggg

SEQ ID NO: 85770 - DNA, 23 bp, Homo sapiens
ctgcttgggaacagagtggggcc

SEQ ID NO: 85771 - DNA, 20 bp, Homo sapiens
tgcctggtggcagggagggg

SEQ ID NO: 85772 - DNA, 16 bp, Homo sapiens
cctggtggggaaggaa

SEQ ID NO: 85773 - DNA, 19 bp, Homo sapiens
gcctggtgggaagcactgg

SEQ ID NO: 85774 - DNA, 19 bp, Homo sapiens
tgtctgctgggaaggatgc

SEQ ID NO: 85775 - DNA, 19 bp, Homo sapiens
tgctaagtagggaacgggg

SEQ ID NO: 85776 - DNA, 21 bp, Homo sapiens
tgctggtgggaaagcatgggc

SEQ ID NO: 85777 - DNA, 22 bp, Homo sapiens
tgactggtgggggcatggggcc

SEQ ID NO: 85778 - DNA, 23 bp, Homo sapiens
tgcctggcgggaaggaaacacgc

SEQ ID NO: 85779 - DNA, 21 bp, Homo sapiens
tgcttgtgtgggagagaagaa

SEQ ID NO: 85780 - DNA, 16 bp, Homo sapiens
tggtgggaggacgggg

SEQ ID NO: 85781 - DNA, 19 bp, Homo sapiens
gcctggccgggagtggggc

SEQ ID NO: 85782 - DNA, 19 bp, Homo sapiens
tgtctggtgggggatggga

SEQ ID NO: 85783 - DNA, 22 bp, Homo sapiens
ctgtcatcggaaggaacggggc

SEQ ID NO: 85784 - DNA, 23 bp, Homo sapiens
tgcctgattacaggggtggggcc

SEQ ID NO: 85785 - DNA, 16 bp, Homo sapiens
tgcctggtgggaaggg

SEQ ID NO: 85786 - DNA, 18 bp, Homo sapiens
ccttggtgggaaaggagg

SEQ ID NO: 85787 - DNA, 17 bp, Homo sapiens
gcttggccggaacgggg

SEQ ID NO: 85788 - DNA, 19 bp, Homo sapiens
tgcctggagctgagtgggg

SEQ ID NO: 85789 - DNA, 19 bp, Homo sapiens
tgccggcaaagggtggggc

SEQ ID NO: 85790 - DNA, 17 bp, Homo sapiens
gcctggtggggagaggc

SEQ ID NO: 85791 - DNA, 17 bp, Homo sapiens
tgcctggtgggaacggg

SEQ ID NO: 85792 - DNA, 18 bp, Homo sapiens
accaggaaagggtggggc

SEQ ID NO: 85793 - DNA, 17 bp, Homo sapiens
tgtctggtgggatgggc

SEQ ID NO: 85794 - DNA, 18 bp, Homo sapiens
tgactggtgggaggggac

SEQ ID NO: 85795 - DNA, 16 bp, Homo sapiens
tgcctggggcacgggg

SEQ ID NO: 85796 - DNA, 21 bp, Homo sapiens
tgctggtggggcctgggggcc

SEQ ID NO: 85797 - DNA, 16 bp, Homo sapiens
tgcctggtgggaaggc

SEQ ID NO: 85798 - DNA, 17 bp, Homo sapiens
tgtgtggtgggagaggg

SEQ ID NO: 85799 - DNA, 17 bp, Homo sapiens
gcctggtaggatggggc

SEQ ID NO: 85800 - DNA, 18 bp, Homo sapiens
tgtctgatgaggcggggc

SEQ ID NO: 85801 - DNA, 21 bp, Homo sapiens
tgcctggtggggcaacacggg

SEQ ID NO: 85802 - DNA, 17 bp, Homo sapiens
cctggcgagggcggggc

SEQ ID NO: 85803 - DNA, 29 bp, Homo sapiens
gcctggtgggggagaggggagcggggccg

SEQ ID NO: 85804 - DNA, 21 bp, Homo sapiens
tgtctggatggaaacggggcc

SEQ ID NO: 85805 - DNA, 25 bp, Homo sapiens
tgcctggtgcggggactctggggcc

SEQ ID NO: 85806 - DNA, 23 bp, Homo sapiens
cctggtggggtggcagaatgggg

SEQ ID NO: 85807 - DNA, 21 bp, Homo sapiens
gcctggcactgggatggggcc

SEQ ID NO: 85808 - DNA, 19 bp, Homo sapiens
tgcctggtgtggggagaac

SEQ ID NO: 85809 - DNA, 16 bp, Homo sapiens
tgcctggaggggaggc

SEQ ID NO: 85810 - DNA, 16 bp, Homo sapiens
ctggtggggaaggggc

SEQ ID NO: 85811 - DNA, 20 bp, Homo sapiens
tgtgtggtgggggaggggac

SEQ ID NO: 85812 - DNA, 17 bp, Homo sapiens
tgcctggcgggagaggc

SEQ ID NO: 85813 - DNA, 25 bp, Homo sapiens
tgcctggtgggatgaggcgagggcc

SEQ ID NO: 85814 - DNA, 24 bp, Homo sapiens
ccttggtgggaggtattgacgggg

SEQ ID NO: 85815 - DNA, 23 bp, Homo sapiens
tgcctggcggggagggcgaggcc

SEQ ID NO: 85816 - DNA, 16 bp, Homo sapiens
tgcatggtgggagaga

SEQ ID NO: 85817 - DNA, 22 bp, Homo sapiens
tgctggtgggaagggcaaggcc

SEQ ID NO: 85818 - DNA, 18 bp, Homo sapiens
tgtctgtgggaaaggcag

SEQ ID NO: 85819 - DNA, 20 bp, Homo sapiens
cctcgggagggaacggggcc

SEQ ID NO: 85820 - DNA, 16 bp, Homo sapiens
tgctggtgggggaagg

SEQ ID NO: 85821 - DNA, 23 bp, Homo sapiens
gcacacgcggggagggcggggcc

SEQ ID NO: 85822 - DNA, 21 bp, Homo sapiens
tgctggaacagggagtggggc

SEQ ID NO: 85823 - DNA, 15 bp, Homo sapiens
tgcctggtggagggg

SEQ ID NO: 85824 - DNA, 23 bp, Homo sapiens
tgcttggtaggagaggaggaacc

SEQ ID NO: 85825 - DNA, 17 bp, Homo sapiens
tgctggtgggaagcagg

SEQ ID NO: 85826 - DNA, 18 bp, Homo sapiens
tgcctggtgtgggggtgc

SEQ ID NO: 85827 - DNA, 19 bp, Homo sapiens
tgcctggtggaaagaggaa

SEQ ID NO: 85828 - DNA, 22 bp, Homo sapiens
cctggtgggggagaggagaggc

SEQ ID NO: 85829 - DNA, 15 bp, Homo sapiens
ctggtgggagaggga

SEQ ID NO: 85830 - DNA, 23 bp, Homo sapiens
gccctccctggaaggacggggcc

SEQ ID NO: 85831 - DNA, 21 bp, Homo sapiens
tgccggtgggaggccctggcc

SEQ ID NO: 85832 - DNA, 23 bp, Homo sapiens
tgggtgctgggaaggaacggggc

SEQ ID NO: 85833 - DNA, 21 bp, Homo sapiens
tgcagcgggaggggcggggcc

SEQ ID NO: 85834 - DNA, 21 bp, Homo sapiens
tgcctggtgggcagggaggcc

SEQ ID NO: 85835 - DNA, 22 bp, Homo sapiens
tgccggtggggaagccaaaggc

SEQ ID NO: 85836 - DNA, 19 bp, Homo sapiens
tgtctggtgggtgggaggc

SEQ ID NO: 85837 - DNA, 19 bp, Homo sapiens
tgctggtggggagcagggc

SEQ ID NO: 85838 - DNA, 16 bp, Homo sapiens
gcctggtggggagggc

SEQ ID NO: 85839 - DNA, 76 bp, Bovine herpesvirus 4
tccatgtttgtttatattattttcaaccttattttaataaagtgggggatatatataaatttaatataaacatggg

SEQ ID NO: 85840 - DNA, 24 bp, Bovine herpesvirus 4
tttatattattttcaaccttattt

SEQ ID NO: 85841 - DNA, 21 bp, Homo sapiens
tattttctgtcaaccttattt

SEQ ID NO: 85842 - DNA, 73 bp, Bovine herpesvirus 1
gcgcccccccccccgcgcgctgtgccgtctgacggaaagcacccgcgtgtagggctgcatataaatggagcgc

SEQ ID NO: 85843 - DNA, 24 bp, Bovine herpesvirus 1
aagcacccgcgtgtagggctgcat

SEQ ID NO: 85844 - DNA, 21 bp, Homo sapiens
gcagtgcccacggagggctgc

SEQ ID NO: 85845 - DNA, 16 bp, Homo sapiens
cccctgcaggctgcat

SEQ ID NO: 85846 - DNA, 20 bp, Homo sapiens
gcagcccaaagcagggctgc

SEQ ID NO: 85847 - DNA, 20 bp, Homo sapiens
gcgtgcgcgtgtacacacat

SEQ ID NO: 85848 - DNA, 23 bp, Homo sapiens
gcgcccgcgagctttgtttgcat

SEQ ID NO: 85849 - DNA, 19 bp, Homo sapiens
gcacccgcggcacagctgc

SEQ ID NO: 85850 - DNA, 16 bp, Homo sapiens
cctatgagggctgcat

SEQ ID NO: 85851 - DNA, 17 bp, Homo sapiens
gcccctcagggctgcat

SEQ ID NO: 85852 - DNA, 18 bp, Homo sapiens
aagcctcatgcagggctg

SEQ ID NO: 85853 - DNA, 19 bp, Homo sapiens
gcttcgtgtgtaggaagca

SEQ ID NO: 85854 - DNA, 21 bp, Homo sapiens
gcacctcccagcaggctgcat

SEQ ID NO: 85855 - DNA, 15 bp, Homo sapiens
aagacccagggctgc

SEQ ID NO: 85856 - DNA, 23 bp, Homo sapiens
aagcatctccactgaggctgcat

SEQ ID NO: 85857 - DNA, 20 bp, Homo sapiens
accgttcgtgttggctgcat

SEQ ID NO: 85858 - DNA, 24 bp, Homo sapiens
aagcatgtgtgtgtgcgcgcgcat

SEQ ID NO: 85859 - DNA, 18 bp, Homo sapiens
gcatccctgcatggctgc

SEQ ID NO: 85860 - DNA, 19 bp, Homo sapiens
aagacctgcacaggttgca

SEQ ID NO: 85861 - DNA, 19 bp, Homo sapiens
ccacctgagagggctgcat

SEQ ID NO: 85862 - DNA, 20 bp, Homo sapiens
gcccctccccagggctgcat

SEQ ID NO: 85863 - DNA, 19 bp, Homo sapiens
acgtgtctgggggctgcat

SEQ ID NO: 85864 - DNA, 23 bp, Homo sapiens
gcagtacctgaactgggctgcat

SEQ ID NO: 85865 - DNA, 100 bp, Paramecium bursaria Chlorella virus 1
gtattttcatacaataattttttaatgtttatagtttatttcaatcgattatcagtatcattgaaatattaacttaacaaaatatgtatgtatagaatac

SEQ ID NO: 85866 - DNA, 24 bp, Paramecium bursaria Chlorella virus 1
tagtttatttcaatcgattatcag

SEQ ID NO: 85867 - DNA, 18 bp, Homo sapiens
tagtttatttcagcatca

SEQ ID NO: 85868 - DNA, 21 bp, Homo sapiens
tagtttatttaaaaccatcag

SEQ ID NO: 85869 - DNA, 82 bp, Human herpesvirus 6B
ttcgaagacattaatactggttttctttctcgttatgacgatcaatatagaggacgcaaagagagaccaatttagattcgag

SEQ ID NO: 85870 - DNA, 24 bp, Human herpesvirus 6B
tagaggacgcaaagagagaccaat

SEQ ID NO: 85871 - DNA, 17 bp, Homo sapiens
tagagaagggagaccaa

SEQ ID NO: 85872 - DNA, 21 bp, Homo sapiens
tagagaggcatagagagacca

SEQ ID NO: 85873 - DNA, 18 bp, Homo sapiens
gaagacgtggagagagac

SEQ ID NO: 85874 - DNA, 17 bp, Homo sapiens
tagaggaccgaagagag

SEQ ID NO: 85875 - DNA, 17 bp, Homo sapiens
tagaggacagtgaaaaa

SEQ ID NO: 85876 - DNA, 16 bp, Homo sapiens
gaggacgcaagagcca

SEQ ID NO: 85877 - DNA, 18 bp, Homo sapiens
cagaggacgcagggacca

SEQ ID NO: 85878 - DNA, 17 bp, Homo sapiens
ggggcagagagagacca

SEQ ID NO: 85879 - DNA, 20 bp, Homo sapiens
tagggggcgcaaagaagaga

SEQ ID NO: 85880 - DNA, 15 bp, Homo sapiens
gaggcgcagagagac

SEQ ID NO: 85881 - DNA, 16 bp, Homo sapiens
ggaggcagagagacca

SEQ ID NO: 85882 - DNA, 102 bp, Chimpanzee cytomegalovirus
gccgccaacccgagcgccggagaaggaggagaaacaagaagaatcactcgagacacggctcagaacccagcgactctttattccgcgtccctcgcacccggc

SEQ ID NO: 85883 - DNA, 24 bp, Chimpanzee cytomegalovirus
agaaggaggagaaacaagaagaat

SEQ ID NO: 85884 - DNA, 19 bp, Homo sapiens
agagaggaggagaaaagaa

SEQ ID NO: 85885 - DNA, 21 bp, Homo sapiens
aaaggaggggataaaggaaga

SEQ ID NO: 85886 - DNA, 16 bp, Homo sapiens
gaaggaagacaagaag

SEQ ID NO: 85887 - DNA, 18 bp, Homo sapiens
aggggaaggagaaacaag

SEQ ID NO: 85888 - DNA, 19 bp, Homo sapiens
gaaagaggaggccaaaaaa

SEQ ID NO: 85889 - DNA, 21 bp, Homo sapiens
agaaggagagggtacagagga

SEQ ID NO: 85890 - DNA, 19 bp, Homo sapiens
agaaggggagattcaggaa

SEQ ID NO: 85891 - DNA, 17 bp, Homo sapiens
gaggaggaggaacagaa

SEQ ID NO: 85892 - DNA, 17 bp, Homo sapiens
aggaggaggagaggaag

SEQ ID NO: 85893 - DNA, 20 bp, Homo sapiens
gagggagaagaaatcacaga

SEQ ID NO: 85894 - DNA, 21 bp, Homo sapiens
ggaggagaggggacaggagga

SEQ ID NO: 85895 - DNA, 22 bp, Homo sapiens
agaaggagagagaagcaagaag

SEQ ID NO: 85896 - DNA, 18 bp, Homo sapiens
agaggaggaggggcaaga

SEQ ID NO: 85897 - DNA, 19 bp, Homo sapiens
aggaggaggaggaaaggag

SEQ ID NO: 85898 - DNA, 18 bp, Homo sapiens
gaaggaggagaggaaaga

SEQ ID NO: 85899 - DNA, 21 bp, Homo sapiens
gaaggagggagagcaagaaaa

SEQ ID NO: 85900 - DNA, 22 bp, Homo sapiens
gaaggaggaggcaatggggaat

SEQ ID NO: 85901 - DNA, 19 bp, Homo sapiens
agacggaggagaagcgaga

SEQ ID NO: 85902 - DNA, 19 bp, Homo sapiens
agaagggggagaaaaggag

SEQ ID NO: 85903 - DNA, 19 bp, Homo sapiens
agagggaggagaggaaaga

SEQ ID NO: 85904 - DNA, 19 bp, Homo sapiens
agatggaggagaaacgaga

SEQ ID NO: 85905 - DNA, 23 bp, Homo sapiens
aggaggaggaggaggagaggaat

SEQ ID NO: 85906 - DNA, 23 bp, Homo sapiens
agtaggaggagcaacgggagaat

SEQ ID NO: 85907 - DNA, 22 bp, Homo sapiens
aaaagggggagaggggcccaag

SEQ ID NO: 85908 - DNA, 18 bp, Homo sapiens
aggaggaggaggagaaga

SEQ ID NO: 85909 - DNA, 18 bp, Homo sapiens
agaaggaggaggaggaag

SEQ ID NO: 85910 - DNA, 23 bp, Homo sapiens
gaaggatgagaaaagagaggaat

SEQ ID NO: 85911 - DNA, 17 bp, Homo sapiens
agaaggaagaggagaag

SEQ ID NO: 85912 - DNA, 16 bp, Homo sapiens
agaaggaggaataaga

SEQ ID NO: 85913 - DNA, 22 bp, Homo sapiens
agagagagggggaacaaggaga

SEQ ID NO: 85914 - DNA, 19 bp, Homo sapiens
agaagggtgggacaagaga

SEQ ID NO: 85915 - DNA, 19 bp, Homo sapiens
gaaggaagggaaggggaag

SEQ ID NO: 85916 - DNA, 22 bp, Homo sapiens
aggaggaggatggaaagagaat

SEQ ID NO: 85917 - DNA, 18 bp, Homo sapiens
gagggagaagaaatgaga

SEQ ID NO: 85918 - DNA, 24 bp, Homo sapiens
gaaggagggggacctcagcagaat

SEQ ID NO: 85919 - DNA, 19 bp, Homo sapiens
agaaggagcgggaagcaaa

SEQ ID NO: 85920 - DNA, 19 bp, Homo sapiens
agagggaggagaagccaag

SEQ ID NO: 85921 - DNA, 23 bp, Homo sapiens
agaggaaggagaactggaaaaga

SEQ ID NO: 85922 - DNA, 20 bp, Homo sapiens
agagtgaggagaacacgaga

SEQ ID NO: 85923 - DNA, 18 bp, Homo sapiens
agagggagggaggaagaa

SEQ ID NO: 85924 - DNA, 17 bp, Homo sapiens
agaaggagaaagggaag

SEQ ID NO: 85925 - DNA, 19 bp, Homo sapiens
gaaggggagaggcaggaag

SEQ ID NO: 85926 - DNA, 21 bp, Homo sapiens
agaaggaagaggggcaggaga

SEQ ID NO: 85927 - DNA, 22 bp, Homo sapiens
gaagagaggggaagagaagaat

SEQ ID NO: 85928 - DNA, 17 bp, Homo sapiens
aggaggaggaggacaag

SEQ ID NO: 85929 - DNA, 18 bp, Homo sapiens
gaagaaggagaaacagga

SEQ ID NO: 85930 - DNA, 21 bp, Homo sapiens
ggagggggaagaaaaaagaat

SEQ ID NO: 85931 - DNA, 18 bp, Homo sapiens
aggagcaggagaaacaaa

SEQ ID NO: 85932 - DNA, 18 bp, Homo sapiens
gaaagaggagaaacgaga

SEQ ID NO: 85933 - DNA, 19 bp, Homo sapiens
aaaggaggggaaatctgaa

SEQ ID NO: 85934 - DNA, 22 bp, Homo sapiens
aggaagaggagagggtaggaga

SEQ ID NO: 85935 - DNA, 18 bp, Homo sapiens
ggaggagagaacaagaag

SEQ ID NO: 85936 - DNA, 20 bp, Homo sapiens
agaaggaggggggaaaaaca

SEQ ID NO: 85937 - DNA, 17 bp, Homo sapiens
aggaggaggaggagaag

SEQ ID NO: 85938 - DNA, 19 bp, Homo sapiens
ggagggagaaaccaaggag

SEQ ID NO: 85939 - DNA, 19 bp, Homo sapiens
aaaaggagggaaggaagaa

SEQ ID NO: 85940 - DNA, 17 bp, Homo sapiens
aaggaggaggagaagaa

SEQ ID NO: 85941 - DNA, 19 bp, Homo sapiens
ggaggagaggaatgagaat

SEQ ID NO: 85942 - DNA, 17 bp, Homo sapiens
aaggaggagacaaggag

SEQ ID NO: 85943 - DNA, 22 bp, Homo sapiens
gaaggatgggaggggtcaggaa

SEQ ID NO: 85944 - DNA, 22 bp, Homo sapiens
aggaggctgaggcaagaagaat

SEQ ID NO: 85945 - DNA, 20 bp, Homo sapiens
agaaggaagggagacagaaa

SEQ ID NO: 85946 - DNA, 22 bp, Homo sapiens
agaaggggtgggagagaagaat

SEQ ID NO: 85947 - DNA, 22 bp, Homo sapiens
agaagggagggaggggaagaat

SEQ ID NO: 85948 - DNA, 19 bp, Homo sapiens
gagggggaaaaacaaaaga

SEQ ID NO: 85949 - DNA, 18 bp, Homo sapiens
aggaagaggaggaatgaa

SEQ ID NO: 85950 - DNA, 22 bp, Homo sapiens
aggaggaggagggcgaggagaa

SEQ ID NO: 85951 - DNA, 19 bp, Homo sapiens
agaaagaggaggagtaaga

SEQ ID NO: 85952 - DNA, 22 bp, Homo sapiens
agaggaggagagagggaggaga

SEQ ID NO: 85953 - DNA, 20 bp, Homo sapiens
aaggggaaaagacagggaga

SEQ ID NO: 85954 - DNA, 18 bp, Homo sapiens
agagggagaaggaacaag

SEQ ID NO: 85955 - DNA, 18 bp, Homo sapiens
agagggaggggaaataga

SEQ ID NO: 85956 - DNA, 18 bp, Homo sapiens
agaagaggaggaataaga

SEQ ID NO: 85957 - DNA, 16 bp, Homo sapiens
aggaggaggaggaaga

SEQ ID NO: 85958 - DNA, 19 bp, Homo sapiens
aggaggatgagaaacagga

SEQ ID NO: 85959 - DNA, 24 bp, Homo sapiens
agaggaggaggcgcaggggagaat

SEQ ID NO: 85960 - DNA, 19 bp, Homo sapiens
aggaggaggagcaaggaga

SEQ ID NO: 85961 - DNA, 21 bp, Homo sapiens
ggaggaggacggacaggaaaa

SEQ ID NO: 85962 - DNA, 22 bp, Homo sapiens
gaaggagagagtagccagggaa

SEQ ID NO: 85963 - DNA, 17 bp, Homo sapiens
agaggagacaggaggaa

SEQ ID NO: 85964 - DNA, 25 bp, Homo sapiens
agaagaaaaatcaagtggggagaat

SEQ ID NO: 85965 - DNA, 17 bp, Homo sapiens
aaaggaggagaaacaga

SEQ ID NO: 85966 - DNA, 18 bp, Homo sapiens
gatggaggagaggcaaga

SEQ ID NO: 85967 - DNA, 19 bp, Homo sapiens
agaaggagggggaacaaaa

SEQ ID NO: 85968 - DNA, 18 bp, Homo sapiens
gaagaaggagagacagaa

SEQ ID NO: 85969 - DNA, 22 bp, Homo sapiens
ggaggagaaaactaggaagaat

SEQ ID NO: 85970 - DNA, 17 bp, Homo sapiens
aagaagagcaggaagaa

SEQ ID NO: 85971 - DNA, 20 bp, Homo sapiens
gaaggaggaggaggaagaag

SEQ ID NO: 85972 - DNA, 17 bp, Homo sapiens
aaaagagaacaagagga

SEQ ID NO: 85973 - DNA, 20 bp, Homo sapiens
agaaggagggaggaaggaag

SEQ ID NO: 85974 - DNA, 20 bp, Homo sapiens
aaggaggagcccagaggaga

SEQ ID NO: 85975 - DNA, 17 bp, Homo sapiens
agaagcgaggagagaag

SEQ ID NO: 85976 - DNA, 21 bp, Homo sapiens
agaaggaggtgggaaacagga

SEQ ID NO: 85977 - DNA, 21 bp, Homo sapiens
agaaggaggatgaatgcaaag

SEQ ID NO: 85978 - DNA, 19 bp, Homo sapiens
aggagggggagaggagaga

SEQ ID NO: 85979 - DNA, 22 bp, Homo sapiens
gaaggagaagaaacaaaagaat

SEQ ID NO: 85980 - DNA, 19 bp, Homo sapiens
aggaggaagaaagaggaag

SEQ ID NO: 85981 - DNA, 22 bp, Homo sapiens
aggaggaggaggaacaagagga

SEQ ID NO: 85982 - DNA, 19 bp, Homo sapiens
aggaggaggaggaacaaga

SEQ ID NO: 85983 - DNA, 22 bp, Homo sapiens
gagggaggagaagggaggagaa

SEQ ID NO: 85984 - DNA, 18 bp, Homo sapiens
agaagcaggagaaacgag

SEQ ID NO: 85985 - DNA, 16 bp, Homo sapiens
gaggagcaagaagaat

SEQ ID NO: 85986 - DNA, 19 bp, Homo sapiens
gaaggaggaggaacgacga

SEQ ID NO: 85987 - DNA, 23 bp, Homo sapiens
aggaggagtggggacgcagagga

SEQ ID NO: 85988 - DNA, 19 bp, Homo sapiens
agaagggggagaaataaaa

SEQ ID NO: 85989 - DNA, 21 bp, Homo sapiens
agaagggagagggaaacgtga

SEQ ID NO: 85990 - DNA, 21 bp, Homo sapiens
aggaagaggagcagcaggaag

SEQ ID NO: 85991 - DNA, 26 bp, Homo sapiens
agagggagaagagccaggggaggaat

SEQ ID NO: 85992 - DNA, 17 bp, Homo sapiens
gagggggagaaaaagaa

SEQ ID NO: 85993 - DNA, 19 bp, Homo sapiens
aggagggggaagaaaagaa

SEQ ID NO: 85994 - DNA, 20 bp, Homo sapiens
agaggaggaggaatggaaga

SEQ ID NO: 85995 - DNA, 19 bp, Homo sapiens
agaagaaaatatgagaaga

SEQ ID NO: 85996 - DNA, 19 bp, Homo sapiens
agcaggaggagggacgaag

SEQ ID NO: 85997 - DNA, 21 bp, Homo sapiens
agagggaggagaagaggagga

SEQ ID NO: 85998 - DNA, 18 bp, Homo sapiens
aaaagagggtaagaagaa

SEQ ID NO: 85999 - DNA, 18 bp, Homo sapiens
agaaggaaggaagggaga

SEQ ID NO: 86000 - DNA, 16 bp, Homo sapiens
gaaggaggaggagaaa

SEQ ID NO: 86001 - DNA, 23 bp, Homo sapiens
ggaggagaggcagggggaggaat

SEQ ID NO: 86002 - DNA, 24 bp, Homo sapiens
agaagactgggaaacaagaggaat

SEQ ID NO: 86003 - DNA, 18 bp, Homo sapiens
aaaagggggagaaacaag

SEQ ID NO: 86004 - DNA, 17 bp, Homo sapiens
gaaggaggagaggaaga

SEQ ID NO: 86005 - DNA, 22 bp, Homo sapiens
agaagagaggggagggcaagaa

SEQ ID NO: 86006 - DNA, 17 bp, Homo sapiens
gaaggaagagagaagaa

SEQ ID NO: 86007 - DNA, 20 bp, Homo sapiens
agaaggggaggagatggaga

SEQ ID NO: 86008 - DNA, 18 bp, Homo sapiens
agaaggagggaaacagga

SEQ ID NO: 86009 - DNA, 17 bp, Homo sapiens
gaaggcgggaggaagaa

SEQ ID NO: 86010 - DNA, 18 bp, Homo sapiens
gagggaggagaaaaaaga

SEQ ID NO: 86011 - DNA, 18 bp, Homo sapiens
gaaagaggagagcaggaa

SEQ ID NO: 86012 - DNA, 19 bp, Homo sapiens
aggaggacgagagatgaac

SEQ ID NO: 86013 - DNA, 20 bp, Homo sapiens
agaggaaggacagaggaaga

SEQ ID NO: 86014 - DNA, 18 bp, Homo sapiens
aggaggaagagaacagaa

SEQ ID NO: 86015 - DNA, 19 bp, Homo sapiens
ggaggagggggaaaaagaa

SEQ ID NO: 86016 - DNA, 18 bp, Homo sapiens
agaaggagagggaacaag

SEQ ID NO: 86017 - DNA, 24 bp, Homo sapiens
agaggggagagagatggaagcaga

SEQ ID NO: 86018 - DNA, 18 bp, Homo sapiens
agaaagaggagacaggaa

SEQ ID NO: 86019 - DNA, 21 bp, Homo sapiens
aggaagagggttgggaagaat

SEQ ID NO: 86020 - DNA, 19 bp, Homo sapiens
agagggaggggaaaaagaa

SEQ ID NO: 86021 - DNA, 23 bp, Homo sapiens
gagggagggagaaatgcaggaaa

SEQ ID NO: 86022 - DNA, 22 bp, Homo sapiens
gatggaggatagcaagaagaat

SEQ ID NO: 86023 - DNA, 17 bp, Homo sapiens
gatggaggagaagaaga

SEQ ID NO: 86024 - DNA, 20 bp, Homo sapiens
aggaggaggaggaaaataag

SEQ ID NO: 86025 - DNA, 21 bp, Homo sapiens
agaagaggaggaggccgagga

SEQ ID NO: 86026 - DNA, 17 bp, Homo sapiens
gaaggagagaaaaagaa

SEQ ID NO: 86027 - DNA, 19 bp, Homo sapiens
agaggaggagaggtgaaga

SEQ ID NO: 86028 - DNA, 22 bp, Homo sapiens
gaaagaggactgggagaggaat

SEQ ID NO: 86029 - DNA, 18 bp, Homo sapiens
gaaggagggaaagcgaaa

SEQ ID NO: 86030 - DNA, 18 bp, Homo sapiens
agaaagacacaggaagaa

SEQ ID NO: 86031 - DNA, 25 bp, Homo sapiens
agaaggcaggacagatgcaagaaga

SEQ ID NO: 86032 - DNA, 22 bp, Homo sapiens
agaggtgaggactaagaagaat

SEQ ID NO: 86033 - DNA, 23 bp, Homo sapiens
aggaggaggagaagcgcaaggag

SEQ ID NO: 86034 - DNA, 18 bp, Homo sapiens
gaggaggagggaagcaga

SEQ ID NO: 86035 - DNA, 22 bp, Homo sapiens
aggagagggagaaatgggagaa

SEQ ID NO: 86036 - DNA, 20 bp, Homo sapiens
agaaggaagagggtatagaa

SEQ ID NO: 86037 - DNA, 23 bp, Homo sapiens
agcaggaggagaggcccagagga

SEQ ID NO: 86038 - DNA, 22 bp, Homo sapiens
aaaaggaggaggggcagaagaa

SEQ ID NO: 86039 - DNA, 24 bp, Homo sapiens
gaagggggatgaaaggcctggaat

SEQ ID NO: 86040 - DNA, 23 bp, Homo sapiens
gaaggaggggaaatgtcagccag

SEQ ID NO: 86041 - DNA, 19 bp, Homo sapiens
agaatgaggagaagggaga

SEQ ID NO: 86042 - DNA, 16 bp, Homo sapiens
gaagggggagaacaga

SEQ ID NO: 86043 - DNA, 19 bp, Homo sapiens
gaaggagaggaacagaaaa

SEQ ID NO: 86044 - DNA, 21 bp, Homo sapiens
aggaggaagaaacgcaggaag

SEQ ID NO: 86045 - DNA, 17 bp, Homo sapiens
agaaggagggagcagaa

SEQ ID NO: 86046 - DNA, 22 bp, Homo sapiens
gaacgaggagaagagaggaaga

SEQ ID NO: 86047 - DNA, 17 bp, Homo sapiens
agtaggaggaaagaaga

SEQ ID NO: 86048 - DNA, 16 bp, Homo sapiens
agaagaggaatgaaga

SEQ ID NO: 86049 - DNA, 18 bp, Homo sapiens
agagggaggaaagacgag

SEQ ID NO: 86050 - DNA, 21 bp, Homo sapiens
gaaggggtgtgcaagaagaat

SEQ ID NO: 86051 - DNA, 16 bp, Homo sapiens
agaagaaggaggaaga

SEQ ID NO: 86052 - DNA, 18 bp, Homo sapiens
aggaggaagagaaatgag

SEQ ID NO: 86053 - DNA, 17 bp, Homo sapiens
gagggaggaaagaagaa

SEQ ID NO: 86054 - DNA, 18 bp, Homo sapiens
ggaggagaagcaaggaag

SEQ ID NO: 86055 - DNA, 20 bp, Homo sapiens
gaaggagggaggcaagccaa

SEQ ID NO: 86056 - DNA, 19 bp, Homo sapiens
gagggagagagagagaaga

SEQ ID NO: 86057 - DNA, 18 bp, Homo sapiens
aggaggaggagacagaag

SEQ ID NO: 86058 - DNA, 19 bp, Homo sapiens
agcaggaggagaaagggaa

SEQ ID NO: 86059 - DNA, 23 bp, Homo sapiens
aggaggaggaggacgtggaagaa

SEQ ID NO: 86060 - DNA, 19 bp, Homo sapiens
agaaagaggaggaaccgga

SEQ ID NO: 86061 - DNA, 22 bp, Homo sapiens
gaaggagggatgggagctgaat

SEQ ID NO: 86062 - DNA, 22 bp, Homo sapiens
gaaggaggggaagtgtagaaaa

SEQ ID NO: 86063 - DNA, 20 bp, Homo sapiens
aagaaggagatcttgagaag

SEQ ID NO: 86064 - DNA, 18 bp, Homo sapiens
gaagggggagagagaaaa

SEQ ID NO: 86065 - DNA, 17 bp, Homo sapiens
gaaggaggaaaccagaa

SEQ ID NO: 86066 - DNA, 20 bp, Homo sapiens
ggaagaggaaacatgggaag

SEQ ID NO: 86067 - DNA, 20 bp, Homo sapiens
aggagggtgggaaacaaaaa

SEQ ID NO: 86068 - DNA, 20 bp, Homo sapiens
agagagcctaagcaagaaga

SEQ ID NO: 86069 - DNA, 19 bp, Homo sapiens
aaaggagggagggaggaat

SEQ ID NO: 86070 - DNA, 22 bp, Homo sapiens
gaaggggagagggagggagaat

SEQ ID NO: 86071 - DNA, 19 bp, Homo sapiens
agatgggaggagagaaaag

SEQ ID NO: 86072 - DNA, 18 bp, Homo sapiens
agagggaggagagaaaga

SEQ ID NO: 86073 - DNA, 23 bp, Homo sapiens
aggaggaggagcaggtggagaaa

SEQ ID NO: 86074 - DNA, 22 bp, Homo sapiens
agaaggggaggagtgaaactag

SEQ ID NO: 86075 - DNA, 21 bp, Homo sapiens
aggaggaggagacgctgaaga

SEQ ID NO: 86076 - DNA, 18 bp, Homo sapiens
aggaggaagacaggagga

SEQ ID NO: 86077 - DNA, 20 bp, Homo sapiens
gaaagaggccagggaagaat

SEQ ID NO: 86078 - DNA, 19 bp, Homo sapiens
aggaggaggaggaagaaga

SEQ ID NO: 86079 - DNA, 22 bp, Homo sapiens
gaagaaggagaagaaggagaat

SEQ ID NO: 86080 - DNA, 18 bp, Homo sapiens
gaaggaggggagagaaga

SEQ ID NO: 86081 - DNA, 16 bp, Homo sapiens
agaaggaggaggaaga

SEQ ID NO: 86082 - DNA, 26 bp, Homo sapiens
agaatgggaatgggaataagaagaat

SEQ ID NO: 86083 - DNA, 23 bp, Homo sapiens
aggaggagagggggtgaaagaat

SEQ ID NO: 86084 - DNA, 18 bp, Homo sapiens
agaaggggagggagacga

SEQ ID NO: 86085 - DNA, 18 bp, Homo sapiens
aggaggaggaggaaaaag

SEQ ID NO: 86086 - DNA, 21 bp, Homo sapiens
gaaggagggggagaggccaaa

SEQ ID NO: 86087 - DNA, 18 bp, Homo sapiens
agaaggagaaggcaaaga

SEQ ID NO: 86088 - DNA, 18 bp, Homo sapiens
agaaggaggagaaggcag

SEQ ID NO: 86089 - DNA, 23 bp, Homo sapiens
agaagaggaggccagaggagaat

SEQ ID NO: 86090 - DNA, 23 bp, Homo sapiens
gaaggaggcagggaaagtggaat

SEQ ID NO: 86091 - DNA, 20 bp, Homo sapiens
aggaggagagagaaacagga

SEQ ID NO: 86092 - DNA, 19 bp, Homo sapiens
aaggaggagagagacagga

SEQ ID NO: 86093 - DNA, 17 bp, Homo sapiens
agaggggggaagacaag

SEQ ID NO: 86094 - DNA, 23 bp, Homo sapiens
gagggaggaggaaagcaagctaa

SEQ ID NO: 86095 - DNA, 16 bp, Homo sapiens
gaaggaggagaggaag

SEQ ID NO: 86096 - DNA, 21 bp, Homo sapiens
aggaggaagagaagtagcaag

SEQ ID NO: 86097 - DNA, 18 bp, Homo sapiens
aggtgaaaagcaagaaga

SEQ ID NO: 86098 - DNA, 21 bp, Homo sapiens
agaggagagagacagaagaat

SEQ ID NO: 86099 - DNA, 20 bp, Homo sapiens
aggaagaggagaggatagaa

SEQ ID NO: 86100 - DNA, 18 bp, Homo sapiens
agaaggagtagaagcaga

SEQ ID NO: 86101 - DNA, 20 bp, Homo sapiens
aggaggaggggcaggacgaa

SEQ ID NO: 86102 - DNA, 18 bp, Homo sapiens
ggaggagagaaagagaga

SEQ ID NO: 86103 - DNA, 25 bp, Homo sapiens
gagggaggagacagtctcggagaat

SEQ ID NO: 86104 - DNA, 18 bp, Homo sapiens
gaaggagggagaaacaag

SEQ ID NO: 86105 - DNA, 18 bp, Homo sapiens
gaaggagagaaacagcga

SEQ ID NO: 86106 - DNA, 21 bp, Homo sapiens
gaaggaggcagagataagcga

SEQ ID NO: 86107 - DNA, 18 bp, Homo sapiens
gaaggaggaggaagcaag

SEQ ID NO: 86108 - DNA, 17 bp, Homo sapiens
aggaggaagagaaagaa

SEQ ID NO: 86109 - DNA, 21 bp, Homo sapiens
aggaggaggaggattgagaga

SEQ ID NO: 86110 - DNA, 22 bp, Homo sapiens
agaaagaggaggaggaggagga

SEQ ID NO: 86111 - DNA, 22 bp, Homo sapiens
agaaagggtaactataagaaga

SEQ ID NO: 86112 - DNA, 16 bp, Homo sapiens
agagggaggagagaag

SEQ ID NO: 86113 - DNA, 18 bp, Homo sapiens
aggaggaggagaaggaga

SEQ ID NO: 86114 - DNA, 19 bp, Homo sapiens
agaagaaggaggggcaaaa

SEQ ID NO: 86115 - DNA, 20 bp, Homo sapiens
agaaggaggagtagaggaga

SEQ ID NO: 86116 - DNA, 19 bp, Homo sapiens
aggaggaggaggggacaag

SEQ ID NO: 86117 - DNA, 20 bp, Homo sapiens
agaaggaggaggaggagaag

SEQ ID NO: 86118 - DNA, 16 bp, Homo sapiens
aggaggagaagaagaa

SEQ ID NO: 86119 - DNA, 18 bp, Homo sapiens
gaatgaggagaatcagaa

SEQ ID NO: 86120 - DNA, 19 bp, Homo sapiens
agcaggaggaagaggaaga

SEQ ID NO: 86121 - DNA, 18 bp, Homo sapiens
agaagaaggaggaatcag

SEQ ID NO: 86122 - DNA, 21 bp, Homo sapiens
gaaggagaagaaacaaagaat

SEQ ID NO: 86123 - DNA, 15 bp, Homo sapiens
ggaggcaagaagaat

SEQ ID NO: 86124 - DNA, 25 bp, Homo sapiens
aggaggagagggaacaagcttcaga

SEQ ID NO: 86125 - DNA, 21 bp, Homo sapiens
agaagggggagcagaaagaat

SEQ ID NO: 86126 - DNA, 21 bp, Homo sapiens
agaaggaagggggaaaagaat

SEQ ID NO: 86127 - DNA, 24 bp, Homo sapiens
gagggaaggagatggccagagaag

SEQ ID NO: 86128 - DNA, 18 bp, Homo sapiens
aggagaaggagaagcaaa

SEQ ID NO: 86129 - DNA, 22 bp, Homo sapiens
agaaggagaggaaacaggagga

SEQ ID NO: 86130 - DNA, 22 bp, Homo sapiens
agaaggatggagggaaaacaag

SEQ ID NO: 86131 - DNA, 20 bp, Homo sapiens
agaggagaaagtatgagaga

SEQ ID NO: 86132 - DNA, 17 bp, Homo sapiens
gaaggagaagaatgaga

SEQ ID NO: 86133 - DNA, 17 bp, Homo sapiens
agagggaggagagaaga

SEQ ID NO: 86134 - DNA, 22 bp, Homo sapiens
aggaagagaaaacagcgggaag

SEQ ID NO: 86135 - DNA, 24 bp, Homo sapiens
aggaggaagagggaaatgaagaat

SEQ ID NO: 86136 - DNA, 22 bp, Homo sapiens
agaaggaggagtggccaccaga

SEQ ID NO: 86137 - DNA, 21 bp, Homo sapiens
agaagaaggagaagtcacaaa

SEQ ID NO: 86138 - DNA, 18 bp, Homo sapiens
agcaggaggaggaacaga

SEQ ID NO: 86139 - DNA, 19 bp, Homo sapiens
agaaggagagaggagagga

SEQ ID NO: 86140 - DNA, 17 bp, Homo sapiens
gaaggaggggaaggaag

SEQ ID NO: 86141 - DNA, 18 bp, Homo sapiens
ggaggagggaagaagaat

SEQ ID NO: 86142 - DNA, 18 bp, Homo sapiens
aggagaaggagaagcaag

SEQ ID NO: 86143 - DNA, 20 bp, Homo sapiens
agaaggaagaggacaatgga

SEQ ID NO: 86144 - DNA, 24 bp, Homo sapiens
agaaggaagggaaaatttaagaat

SEQ ID NO: 86145 - DNA, 16 bp, Homo sapiens
agaagaggagagaaga

SEQ ID NO: 86146 - DNA, 18 bp, Homo sapiens
aggaggaggagaaaggag

SEQ ID NO: 86147 - DNA, 22 bp, Homo sapiens
aggaggaggagaaaggagggga

SEQ ID NO: 86148 - DNA, 17 bp, Homo sapiens
aaaaggagagcaggaag

SEQ ID NO: 86149 - DNA, 21 bp, Homo sapiens
agaatgaaaaagaataggaag

SEQ ID NO: 86150 - DNA, 20 bp, Homo sapiens
agactgggggagcaggaaga

SEQ ID NO: 86151 - DNA, 21 bp, Homo sapiens
agaaggaagaggggggcaaag

SEQ ID NO: 86152 - DNA, 20 bp, Homo sapiens
agcaggaggagattagagga

SEQ ID NO: 86153 - DNA, 21 bp, Homo sapiens
agagggtagggggcaagaaga

SEQ ID NO: 86154 - DNA, 18 bp, Homo sapiens
agagggaggagagaaaag

SEQ ID NO: 86155 - DNA, 17 bp, Homo sapiens
aggaggaagagaagaac

SEQ ID NO: 86156 - DNA, 24 bp, Homo sapiens
agataaaagagaaacaagaagaat

SEQ ID NO: 86157 - DNA, 24 bp, Homo sapiens
agaaggaggagcaggtagggaaat

SEQ ID NO: 86158 - DNA, 19 bp, Homo sapiens
aggagtgaggaggcaggaa

SEQ ID NO: 86159 - DNA, 24 bp, Homo sapiens
aggaggaagggagcaggccagaag

SEQ ID NO: 86160 - DNA, 17 bp, Homo sapiens
agggggaggagagaaga

SEQ ID NO: 86161 - DNA, 67 bp, Macaca mulatta rhadinovirus
ggttggattgtttgtgtacatttattttcattttgtgtacatttattttcattaaagcgatctgacc

SEQ ID NO: 86162 - DNA, 24 bp, Macaca mulatta rhadinovirus
tacatttattttcattaaagcgat

SEQ ID NO: 86163 - DNA, 21 bp, Homo sapiens
ctcaagcttcattaaagtgat

SEQ ID NO: 86164 - DNA, 20 bp, Homo sapiens
tacatttatttttttcaaag

SEQ ID NO: 86165 - DNA, 82 bp, Meleagrid herpesvirus 1
tactgttaaaggctccagggaaactgaattagagcctagagtacgttgacgttagaatggtctacttggggtttctacagtg

SEQ ID NO: 86166 - DNA, 24 bp, Meleagrid herpesvirus 1
ttaaaggctccagggaaactgaat

SEQ ID NO: 86167 - DNA, 22 bp, Homo sapiens
ttaaagactctggaagtgttga

SEQ ID NO: 86168 - DNA, 18 bp, Homo sapiens
tcaaaggagggaaactga

SEQ ID NO: 86169 - DNA, 16 bp, Homo sapiens
ttaaaagctagactga

SEQ ID NO: 86170 - DNA, 21 bp, Homo sapiens
ttaaagggtcattaactgaat

SEQ ID NO: 86171 - DNA, 19 bp, Homo sapiens
aggggcagggaaactgaat

SEQ ID NO: 86172 - DNA, 20 bp, Homo sapiens
ttaagggtcccagggagacc

SEQ ID NO: 86173 - DNA, 16 bp, Homo sapiens
taaaggccagaaactg

SEQ ID NO: 86174 - DNA, 19 bp, Homo sapiens
ttaaaggcctgaagctgaa

SEQ ID NO: 86175 - DNA, 19 bp, Homo sapiens
ttaaaagctcaagaaactg

SEQ ID NO: 86176 - DNA, 19 bp, Homo sapiens
ttaaaagctaaagaaactg

SEQ ID NO: 86177 - DNA, 18 bp, Homo sapiens
agggtccaggaagcctga

SEQ ID NO: 86178 - DNA, 15 bp, Homo sapiens
aaagctccagggccg

SEQ ID NO: 86179 - DNA, 18 bp, Homo sapiens
ttaaaggctgcggctgaa

SEQ ID NO: 86180 - DNA, 17 bp, Homo sapiens
aaggtccaggaaacctg

SEQ ID NO: 86181 - DNA, 18 bp, Homo sapiens
taaaggttggagaaactg

SEQ ID NO: 86182 - DNA, 17 bp, Homo sapiens
agctttggaaactgaat

SEQ ID NO: 86183 - DNA, 17 bp, Homo sapiens
aagacaagggaaactga

SEQ ID NO: 86184 - DNA, 87 bp, Molluscum contagiosum virus
gcgcgtattttttcttcactgttgtcggcgtcctctagcgagcgcacgaagattgccgcccaccgacctgttcgaaagagtgcgcgc

SEQ ID NO: 86185 - DNA, 24 bp, Molluscum contagiosum virus
gcgtattttttcttcactgttgtc

SEQ ID NO: 86186 - DNA, 20 bp, Homo sapiens
gcgtgtttttcctttacagc

SEQ ID NO: 86187 - DNA, 18 bp, Homo sapiens
gtattttttctctttgtt

SEQ ID NO: 86188 - DNA, 23 bp, Homo sapiens
cgtattttttttggattgttgtc

SEQ ID NO: 86189 - DNA, 19 bp, Homo sapiens
tcccctcttcactgttgtc

SEQ ID NO: 86190 - DNA, 20 bp, Homo sapiens
gcgattttttcttcaatatt

SEQ ID NO: 86191 - DNA, 19 bp, Homo sapiens
gtatttttttcacatttgt

SEQ ID NO: 86192 - DNA, 18 bp, Homo sapiens
gtattttttcttcatatt

SEQ ID NO: 86193 - DNA, 22 bp, Homo sapiens
gtctcctttcttcattgttgtc

SEQ ID NO: 86194 - DNA, 18 bp, Homo sapiens
tttttctttattgttgtc

SEQ ID NO: 86195 - DNA, 94 bp, Molluscum contagiosum virus
tttgccccccccccgacgcgagaaagaccttgtcagtgggcgttacagcaccttgcctcttcacgatcaagacatttctcctccggggcgcaag

SEQ ID NO: 86196 - DNA, 22 bp, Molluscum contagiosum virus
catttctcctccggggcgcaag

SEQ ID NO: 86197 - DNA, 19 bp, Homo sapiens
tttctcctctgcggccaag

SEQ ID NO: 86198 - DNA, 18 bp, Homo sapiens
cacttctcttcccacagg

SEQ ID NO: 86199 - DNA, 20 bp, Homo sapiens
catttctcttccaccccagg

SEQ ID NO: 86200 - DNA, 17 bp, Homo sapiens
cctccctccggggcgca

SEQ ID NO: 86201 - DNA, 19 bp, Homo sapiens
catctctcctcttctcagg

SEQ ID NO: 86202 - DNA, 18 bp, Homo sapiens
atttctccccaaaccaag

SEQ ID NO: 86203 - DNA, 18 bp, Homo sapiens
ttctctccagggtgcaag

SEQ ID NO: 86204 - DNA, 17 bp, Homo sapiens
cattttcctccaaaaca

SEQ ID NO: 86205 - DNA, 19 bp, Homo sapiens
tttctcctttgcaatcaag

SEQ ID NO: 86206 - DNA, 18 bp, Homo sapiens
catttcccctttcctggg

SEQ ID NO: 86207 - DNA, 15 bp, Homo sapiens
catttctcctcccac

SEQ ID NO: 86208 - DNA, 17 bp, Homo sapiens
cattcctcctcctggca

SEQ ID NO: 86209 - DNA, 20 bp, Homo sapiens
catttctccagctgtgcaag

SEQ ID NO: 86210 - DNA, 18 bp, Homo sapiens
tttctcacttcccacaag

SEQ ID NO: 86211 - DNA, 20 bp, Homo sapiens
tttctcctctgagttcagca

SEQ ID NO: 86212 - DNA, 18 bp, Homo sapiens
catttctccttcccaagg

SEQ ID NO: 86213 - DNA, 20 bp, Homo sapiens
catttctccctctgcacaag

SEQ ID NO: 86214 - DNA, 18 bp, Homo sapiens
catttctcctccgggaca

SEQ ID NO: 86215 - DNA, 21 bp, Homo sapiens
catttccccttctctcccaag

SEQ ID NO: 86216 - DNA, 20 bp, Homo sapiens
catttctcccctgatccagg

SEQ ID NO: 86217 - DNA, 19 bp, Homo sapiens
cttctccctctggggtgca

SEQ ID NO: 86218 - DNA, 17 bp, Homo sapiens
catttctcctcgggaca

SEQ ID NO: 86219 - DNA, 16 bp, Homo sapiens
attcctcctctgcaca

SEQ ID NO: 86220 - DNA, 20 bp, Homo sapiens
catttctcttctttcacaag

SEQ ID NO: 86221 - DNA, 21 bp, Homo sapiens
catttcccctccatttgtagg

SEQ ID NO: 86222 - DNA, 19 bp, Homo sapiens
catttctcccccagttgca

SEQ ID NO: 86223 - DNA, 19 bp, Homo sapiens
catttctcctcccaacagg

SEQ ID NO: 86224 - DNA, 22 bp, Homo sapiens
catttctccttctcctaatggg

SEQ ID NO: 86225 - DNA, 17 bp, Homo sapiens
cacttctccacagtgca

SEQ ID NO: 86226 - DNA, 17 bp, Homo sapiens
catttatcctccgccaa

SEQ ID NO: 86227 - DNA, 19 bp, Homo sapiens
tctctcctgcaaaagtgca

SEQ ID NO: 86228 - DNA, 18 bp, Homo sapiens
catttctcctctgtcaag

SEQ ID NO: 86229 - DNA, 17 bp, Homo sapiens
tttctcctcagcttaag

SEQ ID NO: 86230 - DNA, 17 bp, Homo sapiens
catttccctggagagcg

SEQ ID NO: 86231 - DNA, 18 bp, Homo sapiens
ttcctcctccacagcgca

SEQ ID NO: 86232 - DNA, 19 bp, Homo sapiens
catttctctttggggaaca

SEQ ID NO: 86233 - DNA, 19 bp, Homo sapiens
catttctcctcaggcctca

SEQ ID NO: 86234 - DNA, 19 bp, Homo sapiens
catttcccctttagccaag

SEQ ID NO: 86235 - DNA, 18 bp, Homo sapiens
tttctcctccccggacgc

SEQ ID NO: 86236 - DNA, 19 bp, Homo sapiens
catctctcttcccacagca

SEQ ID NO: 86237 - DNA, 22 bp, Homo sapiens
catttctcctcattccttcagg

SEQ ID NO: 86238 - DNA, 19 bp, Homo sapiens
tttctcctccacatccaag

SEQ ID NO: 86239 - DNA, 22 bp, Homo sapiens
catttctcccttgccagccaag

SEQ ID NO: 86240 - DNA, 18 bp, Homo sapiens
atttctccttaatacaag

SEQ ID NO: 86241 - DNA, 20 bp, Homo sapiens
catttctcttcacttccagg

SEQ ID NO: 86242 - DNA, 16 bp, Homo sapiens
atttctcctagcgtaa

SEQ ID NO: 86243 - DNA, 19 bp, Homo sapiens
tttctcctgcgcttgcgca

SEQ ID NO: 86244 - DNA, 20 bp, Homo sapiens
cattcctcctctccagcaag

SEQ ID NO: 86245 - DNA, 19 bp, Homo sapiens
cattttttcctgacacaag

SEQ ID NO: 86246 - DNA, 20 bp, Homo sapiens
catttcttcctttccagtga

SEQ ID NO: 86247 - DNA, 18 bp, Homo sapiens
tttctccttctaaaagca

SEQ ID NO: 86248 - DNA, 19 bp, Homo sapiens
attcctccttttccatgag

SEQ ID NO: 86249 - DNA, 18 bp, Homo sapiens
atttctccttcctccgca

SEQ ID NO: 86250 - DNA, 22 bp, Homo sapiens
cacttctctttcgatgcccaag

SEQ ID NO: 86251 - DNA, 23 bp, Homo sapiens
tttccccttccaatgggcgcaag

SEQ ID NO: 86252 - DNA, 16 bp, Homo sapiens
catttcccctctgcac

SEQ ID NO: 86253 - DNA, 23 bp, Homo sapiens
catttctccacggttcccgtgag

SEQ ID NO: 86254 - DNA, 20 bp, Homo sapiens
catttccctccacaccagcg

SEQ ID NO: 86255 - DNA, 20 bp, Homo sapiens
catttctctgcccgcatgca

SEQ ID NO: 86256 - DNA, 18 bp, Homo sapiens
catctctcttctgcggag

SEQ ID NO: 86257 - DNA, 21 bp, Homo sapiens
catctctcctttgaccctggg

SEQ ID NO: 86258 - DNA, 20 bp, Homo sapiens
catttctccctcccctaaca

SEQ ID NO: 86259 - DNA, 89 bp, Human papillomavirus type 41
caatcataatcatcgccctttcgtgttatttcttgtaacgaattcgttacaaaacacacacacagtatataagatagaggaacggattg

SEQ ID NO: 86260 - DNA, 24 bp, Human papillomavirus type 41
tacaaaacacacacacagtatata

SEQ ID NO: 86261 - DNA, 18 bp, Homo sapiens
tacagacacacacacaca

SEQ ID NO: 86262 - DNA, 22 bp, Homo sapiens
tacataacatatacagcatata

SEQ ID NO: 86263 - DNA, 24 bp, Homo sapiens
tacagaggacacacacagcttata

SEQ ID NO: 86264 - DNA, 26 bp, Homo sapiens
tacagggtcacacacacacacacata

SEQ ID NO: 86265 - DNA, 21 bp, Homo sapiens
cacaaatagcacacagtgtat

SEQ ID NO: 86266 - DNA, 24 bp, Homo sapiens
tacagaaacacacatacatacata

SEQ ID NO: 86267 - DNA, 17 bp, Homo sapiens
tacaaacacacacacag

SEQ ID NO: 86268 - DNA, 21 bp, Homo sapiens
cataaaacacacacagacata

SEQ ID NO: 86269 - DNA, 18 bp, Homo sapiens
tacacggacacacacaca

SEQ ID NO: 86270 - DNA, 18 bp, Homo sapiens
tacagacatgcacacaca

SEQ ID NO: 86271 - DNA, 18 bp, Homo sapiens
tacaacacacatacaata

SEQ ID NO: 86272 - DNA, 20 bp, Homo sapiens
tacaaagcaaacacacacgc

SEQ ID NO: 86273 - DNA, 19 bp, Homo sapiens
tacaaaactacacacacag

SEQ ID NO: 86274 - DNA, 17 bp, Homo sapiens
aaacacacatcaatata

SEQ ID NO: 86275 - DNA, 20 bp, Homo sapiens
taaaaatacacatacagtat

SEQ ID NO: 86276 - DNA, 23 bp, Homo sapiens
tacagagatatacacagtatata

SEQ ID NO: 86277 - DNA, 20 bp, Homo sapiens
tacacaaacacacacatgca

SEQ ID NO: 86278 - DNA, 16 bp, Homo sapiens
aaaacatacacagtat

SEQ ID NO: 86279 - DNA, 16 bp, Homo sapiens
aaacacacaaatatat

SEQ ID NO: 86280 - DNA, 20 bp, Homo sapiens
aaaacacacatacacatata

SEQ ID NO: 86281 - DNA, 20 bp, Homo sapiens
tacacgaacatacacacaca

SEQ ID NO: 86282 - DNA, 19 bp, Homo sapiens
tacaaaatttacacacagt

SEQ ID NO: 86283 - DNA, 24 bp, Homo sapiens
tacaaatacacatacacaaatata

SEQ ID NO: 86284 - DNA, 19 bp, Homo sapiens
aaacatacacacacatata

SEQ ID NO: 86285 - DNA, 20 bp, Homo sapiens
taaaaacatatacacaatat

SEQ ID NO: 86286 - DNA, 19 bp, Homo sapiens
acaggacatacagtacata

SEQ ID NO: 86287 - DNA, 19 bp, Homo sapiens
aaaacaagcacacagtata

SEQ ID NO: 86288 - DNA, 19 bp, Homo sapiens
cacagagtacacacacaca

SEQ ID NO: 86289 - DNA, 20 bp, Homo sapiens
caaaatacacatggagtata

SEQ ID NO: 86290 - DNA, 18 bp, Homo sapiens
taaaaacatacacatagc

SEQ ID NO: 86291 - DNA, 22 bp, Homo sapiens
cacaaagtacaatccagtatat

SEQ ID NO: 86292 - DNA, 19 bp, Homo sapiens
tacagaaaacacacacaca

SEQ ID NO: 86293 - DNA, 21 bp, Homo sapiens
aaaacacactcatactcaata

SEQ ID NO: 86294 - DNA, 19 bp, Homo sapiens
tacaaaactgcatacagta

SEQ ID NO: 86295 - DNA, 23 bp, Homo sapiens
tacacaacacacatgtgtgtata

SEQ ID NO: 86296 - DNA, 26 bp, Homo sapiens
tacacaacaatcaatacacagtatat

SEQ ID NO: 86297 - DNA, 18 bp, Homo sapiens
tacaaaaagtacacacca

SEQ ID NO: 86298 - DNA, 19 bp, Homo sapiens
acagaatacacacacctta

SEQ ID NO: 86299 - DNA, 18 bp, Homo sapiens
tacaaaacacacatcaca

SEQ ID NO: 86300 - DNA, 22 bp, Homo sapiens
tacaaacacacacacaaacata

SEQ ID NO: 86301 - DNA, 16 bp, Homo sapiens
caaaacactacagtat

SEQ ID NO: 86302 - DNA, 22 bp, Homo sapiens
tacaaaaccacacttacatgta

SEQ ID NO: 86303 - DNA, 19 bp, Homo sapiens
tgaaaacacacaccttagt

SEQ ID NO: 86304 - DNA, 15 bp, Homo sapiens
aaaacacaccagcat

SEQ ID NO: 86305 - DNA, 19 bp, Homo sapiens
acaaagcacacacttgtat

SEQ ID NO: 86306 - DNA, 18 bp, Homo sapiens
tacaagtacacacacaca

SEQ ID NO: 86307 - DNA, 21 bp, Homo sapiens
cacaaaatacatacacatata

SEQ ID NO: 86308 - DNA, 18 bp, Homo sapiens
caaagcacacacacacag

SEQ ID NO: 86309 - DNA, 17 bp, Homo sapiens
acacatacacacatata

SEQ ID NO: 86310 - DNA, 19 bp, Homo sapiens
tacaatacacacatgcaca

SEQ ID NO: 86311 - DNA, 25 bp, Homo sapiens
cacagaatacacacagaattatata

SEQ ID NO: 86312 - DNA, 16 bp, Homo sapiens
tacaacacacacacag

SEQ ID NO: 86313 - DNA, 23 bp, Homo sapiens
tacaaacacacacacacacacat

SEQ ID NO: 86314 - DNA, 18 bp, Homo sapiens
tacacaaacacacacaca

SEQ ID NO: 86315 - DNA, 21 bp, Homo sapiens
tacacaacatacacagaagta

SEQ ID NO: 86316 - DNA, 15 bp, Homo sapiens
aaaacacacatatat

SEQ ID NO: 86317 - DNA, 21 bp, Homo sapiens
caaaacacacaattctatata

SEQ ID NO: 86318 - DNA, 17 bp, Homo sapiens
tacaaacacacatgcag

SEQ ID NO: 86319 - DNA, 17 bp, Homo sapiens
acaaaacacacgtacat

SEQ ID NO: 86320 - DNA, 18 bp, Homo sapiens
tacacaacacacacacaa

SEQ ID NO: 86321 - DNA, 16 bp, Homo sapiens
tacaaaagcacacagt

SEQ ID NO: 86322 - DNA, 19 bp, Homo sapiens
tacaaggacacacaaacgt

SEQ ID NO: 86323 - DNA, 19 bp, Homo sapiens
tacaaaacacacaacaata

SEQ ID NO: 86324 - DNA, 20 bp, Homo sapiens
cacgacacatacaaagtata

SEQ ID NO: 86325 - DNA, 17 bp, Homo sapiens
acacacacacatatata

SEQ ID NO: 86326 - DNA, 18 bp, Homo sapiens
tacaaagacacacacaca

SEQ ID NO: 86327 - DNA, 18 bp, Homo sapiens
tacaaaacaccaaatata

SEQ ID NO: 86328 - DNA, 22 bp, Homo sapiens
caaaatacacacactaaatata

SEQ ID NO: 86329 - DNA, 18 bp, Homo sapiens
aaacacacacacattata

SEQ ID NO: 86330 - DNA, 24 bp, Homo sapiens
tacaaaccttgaacatagtatata

SEQ ID NO: 86331 - DNA, 17 bp, Homo sapiens
tacagacacacacacag

SEQ ID NO: 86332 - DNA, 23 bp, Homo sapiens
acaaaacatgcagtcagtgtata

SEQ ID NO: 86333 - DNA, 17 bp, Homo sapiens
aaacacatacacatata

SEQ ID NO: 86334 - DNA, 21 bp, Homo sapiens
aacacacatacacactatata

SEQ ID NO: 86335 - DNA, 22 bp, Homo sapiens
tacacagacacacacacatata

SEQ ID NO: 86336 - DNA, 22 bp, Homo sapiens
tacaatatacacacataaagta

SEQ ID NO: 86337 - DNA, 20 bp, Homo sapiens
tacagacacacgcagcacat

SEQ ID NO: 86338 - DNA, 19 bp, Homo sapiens
aaaacaacacacaccacat

SEQ ID NO: 86339 - DNA, 22 bp, Homo sapiens
tacaaaacaccacacagatata

SEQ ID NO: 86340 - DNA, 16 bp, Homo sapiens
aaactacacagcatat

SEQ ID NO: 86341 - DNA, 17 bp, Homo sapiens
tacaaaacatgcacaat

SEQ ID NO: 86342 - DNA, 17 bp, Homo sapiens
aaacacacacacacata

SEQ ID NO: 86343 - DNA, 19 bp, Homo sapiens
acacacacacaaaaatata

SEQ ID NO: 86344 - DNA, 19 bp, Homo sapiens
aaaacatacacaccttcat

SEQ ID NO: 86345 - DNA, 18 bp, Homo sapiens
aaacatacacatagtata

SEQ ID NO: 86346 - DNA, 18 bp, Homo sapiens
tacaaaacacatcaagta

SEQ ID NO: 86347 - DNA, 23 bp, Homo sapiens
caagatacacacaactcaatata

SEQ ID NO: 86348 - DNA, 20 bp, Homo sapiens
catactgcgcacagtatata

SEQ ID NO: 86349 - DNA, 20 bp, Homo sapiens
tacaagatatcacaccagta

SEQ ID NO: 86350 - DNA, 19 bp, Homo sapiens
caaggtgcacacacagata

SEQ ID NO: 86351 - DNA, 22 bp, Homo sapiens
aaaacacacaatacactatata

SEQ ID NO: 86352 - DNA, 20 bp, Homo sapiens
tacaaaacactgtagcaata

SEQ ID NO: 86353 - DNA, 18 bp, Homo sapiens
tacaaacacacacacaca

SEQ ID NO: 86354 - DNA, 18 bp, Homo sapiens
tacaaaacatttacagta

SEQ ID NO: 86355 - DNA, 21 bp, Homo sapiens
cagaacacacatgagtctata

SEQ ID NO: 86356 - DNA, 23 bp, Homo sapiens
caacacacacatgcacgcgcata

SEQ ID NO: 86357 - DNA, 18 bp, Homo sapiens
tacaatgcacacacaata

SEQ ID NO: 86358 - DNA, 19 bp, Homo sapiens
cacaaagtacacacacgta

SEQ ID NO: 86359 - DNA, 24 bp, Homo sapiens
tacaaaacacaacatgacagtata

SEQ ID NO: 86360 - DNA, 20 bp, Homo sapiens
tacaaacatacgcacaacat

SEQ ID NO: 86361 - DNA, 22 bp, Homo sapiens
tacaaacacacacgcacacata

SEQ ID NO: 86362 - DNA, 18 bp, Homo sapiens
tacacagacacacacaca

SEQ ID NO: 86363 - DNA, 17 bp, Homo sapiens
acacacacacacatata

SEQ ID NO: 86364 - DNA, 16 bp, Homo sapiens
acaaaacacaaagtat

SEQ ID NO: 86365 - DNA, 17 bp, Homo sapiens
cagaacatacacacgca

SEQ ID NO: 86366 - DNA, 20 bp, Homo sapiens
aaacatacacacattatata

SEQ ID NO: 86367 - DNA, 23 bp, Homo sapiens
tacaaagcaacacacaacagcat

SEQ ID NO: 86368 - DNA, 17 bp, Homo sapiens
aaaacacacgcacacac

SEQ ID NO: 86369 - DNA, 17 bp, Homo sapiens
caaaacatacacacgca

SEQ ID NO: 86370 - DNA, 92 bp, Gallid herpesvirus 3
ttgtagtcagggttctagttaagtaggcgccgcgcgatttacgaattagtacatttgggccctgccgcgcagcgagcgtctcacgactgcga

SEQ ID NO: 86371 - DNA, 24 bp, Gallid herpesvirus 3
ttgggccctgccgcgcagcgagcg

SEQ ID NO: 86372 - DNA, 19 bp, Homo sapiens
tcgggcccggcggcgagcg

SEQ ID NO: 86373 - DNA, 21 bp, Homo sapiens
gggcgaggggcgcagcgggcg

SEQ ID NO: 86374 - DNA, 22 bp, Homo sapiens
ttgggccctgtgcctcccagcg

SEQ ID NO: 86375 - DNA, 21 bp, Homo sapiens
ttggaccctgcggggcgagcg

SEQ ID NO: 86376 - DNA, 22 bp, Homo sapiens
ttgggccctgacgggagaggcg

SEQ ID NO: 86377 - DNA, 20 bp, Homo sapiens
ttgggtcctgccaccttgag

SEQ ID NO: 86378 - DNA, 18 bp, Homo sapiens
ttgggccccgggcgggcg

SEQ ID NO: 86379 - DNA, 23 bp, Homo sapiens
ctgggttctcagcgcagcgggcg

SEQ ID NO: 86380 - DNA, 96 bp, Equine herpesvirus 4
ggctactactataaggcctttagcttcgatcttggtgtatacttgcgtgtaggcgcgctaacaaaaaaggggcagcagtctttaatgtcacgggct

SEQ ID NO: 86381 - DNA, 24 bp, Equine herpesvirus 4
tataaggcctttagcttcgatctt

SEQ ID NO: 86382 - DNA, 15 bp, Homo sapiens
aagcctttttgatct

SEQ ID NO: 86383 - DNA, 18 bp, Homo sapiens
atagggcttttagcttca

SEQ ID NO: 86384 - DNA, 18 bp, Homo sapiens
ataaggcttttagcttca

SEQ ID NO: 86385 - DNA, 21 bp, Homo sapiens
catcaaccctttggctttgat

SEQ ID NO: 86386 - DNA, 68 bp, Hendra virus
ccgaacaagtctacatagatcagttattaagaaaaacttaataacgatctctctttacccttgttcgg

SEQ ID NO: 86387 - DNA, 24 bp, Hendra virus
tctacatagatcagttattaagaa

SEQ ID NO: 86388 - DNA, 20 bp, Homo sapiens
tacattgggagttattaaga

SEQ ID NO: 86389 - DNA, 24 bp, Homo sapiens
tctatgcagatcaggtaggtaaga

SEQ ID NO: 86390 - DNA, 21 bp, Homo sapiens
tacatagatgtgctagaagaa

SEQ ID NO: 86391 - DNA, 23 bp, Homo sapiens
tctccatagcccaatattaagaa

SEQ ID NO: 86392 - DNA, 21 bp, Homo sapiens
tctgtatagaccacagttatt

SEQ ID NO: 86393 - DNA, 17 bp, Homo sapiens
tctaccagttattgaga

SEQ ID NO: 86394 - DNA, 23 bp, Homo sapiens
tctgcatagaatcactataagaa

SEQ ID NO: 86395 - DNA, 20 bp, Homo sapiens
tacatagatctgtttattaa

SEQ ID NO: 86396 - DNA, 17 bp, Homo sapiens
ctacataggttctaaga

SEQ ID NO: 86397 - DNA, 20 bp, Homo sapiens
tacatagattgctttaagaa

SEQ ID NO: 86398 - DNA, 18 bp, Homo sapiens
tctgcaaagatcagttat

SEQ ID NO: 86399 - DNA, 60 bp, Equine herpesvirus 1
ctttgtctgtaaaccgtttttattgttggggaattacatagccgggggtgcaagggaaag

SEQ ID NO: 86400 - DNA, 22 bp, Equine herpesvirus 1
tagccgggggtgcaagggaaag

SEQ ID NO: 86401 - DNA, 18 bp, Homo sapiens
gccgggggtggcggaggg

SEQ ID NO: 86402 - DNA, 18 bp, Homo sapiens
gggctggtgcaaagggaa

SEQ ID NO: 86403 - DNA, 21 bp, Homo sapiens
aggaaggggtgcaaggggaag

SEQ ID NO: 86404 - DNA, 22 bp, Homo sapiens
gccggggggcacgaagggaaag

SEQ ID NO: 86405 - DNA, 19 bp, Homo sapiens
gcctgtgtgcgagggaaag

SEQ ID NO: 86406 - DNA, 18 bp, Homo sapiens
gccgggggccgctgggga

SEQ ID NO: 86407 - DNA, 18 bp, Homo sapiens
tagcagggggtgctgggg

SEQ ID NO: 86408 - DNA, 21 bp, Homo sapiens
cagctggggcacaggagggaa

SEQ ID NO: 86409 - DNA, 16 bp, Homo sapiens
tagccaggggtggggg

SEQ ID NO: 86410 - DNA, 19 bp, Homo sapiens
gccgggggtgccgagggga

SEQ ID NO: 86411 - DNA, 17 bp, Homo sapiens
gccgagttgggggaaag

SEQ ID NO: 86412 - DNA, 16 bp, Homo sapiens
gccagggggtggggaa

SEQ ID NO: 86413 - DNA, 19 bp, Homo sapiens
tagtcggggtagtggagag

SEQ ID NO: 86414 - DNA, 19 bp, Homo sapiens
gctggagatgcgcgaggga

SEQ ID NO: 86415 - DNA, 17 bp, Homo sapiens
tagccggaggtgcaggg

SEQ ID NO: 86416 - DNA, 16 bp, Homo sapiens
cagccgggctgaggga

SEQ ID NO: 86417 - DNA, 21 bp, Homo sapiens
gccggggggcggcggagggaa

SEQ ID NO: 86418 - DNA, 20 bp, Homo sapiens
gccggaggtgctggcaggga

SEQ ID NO: 86419 - DNA, 18 bp, Homo sapiens
cgcaggtgcaaggggaag

SEQ ID NO: 86420 - DNA, 22 bp, Homo sapiens
gccggggctccaagagggaaag

SEQ ID NO: 86421 - DNA, 20 bp, Homo sapiens
ggatggctacaaagggaaag

SEQ ID NO: 86422 - DNA, 20 bp, Homo sapiens
cagccgctgaggcaggggga

SEQ ID NO: 86423 - DNA, 17 bp, Homo sapiens
cagctgggggtgcaggg

SEQ ID NO: 86424 - DNA, 21 bp, Homo sapiens
gccgggaggtcgactcggaaa

SEQ ID NO: 86425 - DNA, 17 bp, Homo sapiens
gctgggggtgcagacaa

SEQ ID NO: 86426 - DNA, 18 bp, Homo sapiens
gctggggaagagggaaag

SEQ ID NO: 86427 - DNA, 18 bp, Homo sapiens
gcagggcgagagggaaag

SEQ ID NO: 86428 - DNA, 18 bp, Homo sapiens
gccgggggtagcattgga

SEQ ID NO: 86429 - DNA, 19 bp, Homo sapiens
gctgggggtgcagagggaa

SEQ ID NO: 86430 - DNA, 20 bp, Homo sapiens
tagcagtaggtgggggaaag

SEQ ID NO: 86431 - DNA, 18 bp, Homo sapiens
ggcagggcagagggaaag

SEQ ID NO: 86432 - DNA, 18 bp, Homo sapiens
agtcgggagtagggggaa

SEQ ID NO: 86433 - DNA, 17 bp, Homo sapiens
tagccggggtgggaagg

SEQ ID NO: 86434 - DNA, 16 bp, Homo sapiens
actgggagagggaaag

SEQ ID NO: 86435 - DNA, 18 bp, Homo sapiens
cagttgggggccagggaa

SEQ ID NO: 86436 - DNA, 21 bp, Homo sapiens
ggtggcagcattgagggaaag

SEQ ID NO: 86437 - DNA, 19 bp, Homo sapiens
agccggaacgtgcaaggga

SEQ ID NO: 86438 - DNA, 18 bp, Homo sapiens
gccaggaagcacagggaa

SEQ ID NO: 86439 - DNA, 21 bp, Homo sapiens
gcggggggcgcacctaaggga

SEQ ID NO: 86440 - DNA, 20 bp, Homo sapiens
agtcggtcacagagggaaag

SEQ ID NO: 86441 - DNA, 22 bp, Homo sapiens
cagctgggactgggagggaaag

SEQ ID NO: 86442 - DNA, 20 bp, Homo sapiens
gctggggagaagagggaaag

SEQ ID NO: 86443 - DNA, 16 bp, Homo sapiens
tagccagaggaaggga

SEQ ID NO: 86444 - DNA, 17 bp, Homo sapiens
agtcgggggtgggggaa

SEQ ID NO: 86445 - DNA, 24 bp, Homo sapiens
tagcagggggtgcagccgccaagg

SEQ ID NO: 86446 - DNA, 18 bp, Homo sapiens
agccggggctggggggaa

SEQ ID NO: 86447 - DNA, 17 bp, Homo sapiens
gccatagcaagggaaag

SEQ ID NO: 86448 - DNA, 17 bp, Homo sapiens
tagctgggggtgctgga

SEQ ID NO: 86449 - DNA, 20 bp, Homo sapiens
cagctgggttgtagggaaag

SEQ ID NO: 86450 - DNA, 18 bp, Homo sapiens
gccaggggtgcggcagga

SEQ ID NO: 86451 - DNA, 23 bp, Homo sapiens
gccgaggggcactggcgagggaa

SEQ ID NO: 86452 - DNA, 18 bp, Homo sapiens
cagccggggccgggagag

SEQ ID NO: 86453 - DNA, 20 bp, Homo sapiens
gctgggggtgcagcacagag

SEQ ID NO: 86454 - DNA, 17 bp, Homo sapiens
tagctgagggtggaggg

SEQ ID NO: 86455 - DNA, 15 bp, Homo sapiens
accggggatggggaa

SEQ ID NO: 86456 - DNA, 18 bp, Homo sapiens
gctgggaggaagggaaag

SEQ ID NO: 86457 - DNA, 17 bp, Homo sapiens
tagtcgggagtggaggg

SEQ ID NO: 86458 - DNA, 18 bp, Homo sapiens
gggttaagtgagggaaag

SEQ ID NO: 86459 - DNA, 19 bp, Homo sapiens
gccgggaggtaggggaaag

SEQ ID NO: 86460 - DNA, 16 bp, Homo sapiens
tagctggggtgaaaag

SEQ ID NO: 86461 - DNA, 16 bp, Homo sapiens
tagcctggtggggaaa

SEQ ID NO: 86462 - DNA, 18 bp, Homo sapiens
tagtcgggggtgggggga

SEQ ID NO: 86463 - DNA, 18 bp, Homo sapiens
agctgcggtgagggaaag

SEQ ID NO: 86464 - DNA, 18 bp, Homo sapiens
ggtgggaagcagggaaag

SEQ ID NO: 86465 - DNA, 17 bp, Homo sapiens
tagccgagaaagggaaa

SEQ ID NO: 86466 - DNA, 19 bp, Homo sapiens
cagctgggggtgctgtgga

SEQ ID NO: 86467 - DNA, 18 bp, Homo sapiens
agccgggggtggcagaag

SEQ ID NO: 86468 - DNA, 18 bp, Homo sapiens
tagctgggggcgctgggg

SEQ ID NO: 86469 - DNA, 20 bp, Homo sapiens
tagccaggggttggggggaa

SEQ ID NO: 86470 - DNA, 19 bp, Homo sapiens
gctgggactgaagggaaag

SEQ ID NO: 86471 - DNA, 19 bp, Homo sapiens
actggaagaggagggaaag

SEQ ID NO: 86472 - DNA, 22 bp, Homo sapiens
tagccaggggcctagtgaggga

SEQ ID NO: 86473 - DNA, 17 bp, Homo sapiens
tagccaggggtaggggg

SEQ ID NO: 86474 - DNA, 19 bp, Homo sapiens
gccgggggcgcgctgggga

SEQ ID NO: 86475 - DNA, 16 bp, Homo sapiens
cagctgggggtgagga

SEQ ID NO: 86476 - DNA, 19 bp, Homo sapiens
tagctgggagtgcaggtga

SEQ ID NO: 86477 - DNA, 16 bp, Homo sapiens
agctgagtgcaaggga

SEQ ID NO: 86478 - DNA, 22 bp, Homo sapiens
tagccgggggtcgtaacaacag

SEQ ID NO: 86479 - DNA, 18 bp, Homo sapiens
cagcacagtgcaagggaa

SEQ ID NO: 86480 - DNA, 72 bp, Lettuce infectious yellows virus
ggtaaagttatacatttaccgttggacaaggtaagattaccgacatcctaatagaattgtataacttttgct

SEQ ID NO: 86481 - DNA, 24 bp, Lettuce infectious yellows virus
aaagttatacatttaccgttggac

SEQ ID NO: 86482 - DNA, 20 bp, Homo sapiens
aaagttatcattttcttgga

SEQ ID NO: 86483 - DNA, 23 bp, Homo sapiens
aagttatatactccaagtttgga

SEQ ID NO: 86484 - DNA, 19 bp, Homo sapiens
gttatacattgctcagtgg

SEQ ID NO: 86485 - DNA, 17 bp, Homo sapiens
aagctataattgttgga

SEQ ID NO: 86486 - DNA, 19 bp, Homo sapiens
agttatacattttatttga

SEQ ID NO: 86487 - DNA, 25 bp, Homo sapiens
aaagttatattttatggctgttgga

SEQ ID NO: 86488 - DNA, 19 bp, Homo sapiens
aaagttataccattctgga

SEQ ID NO: 86489 - DNA, 68 bp, Paramecium bursaria Chlorella virus 1
atataatatttcgtcgatacgtgatttctcgtgttttttcatataaaaaagtattatgaatataatat

SEQ ID NO: 86490 - DNA, 24 bp, Paramecium bursaria Chlorella virus 1
taatatttcgtcgatacgtgattt

SEQ ID NO: 86491 - DNA, 23 bp, Homo sapiens
taatattttgttgctcaatacgt

SEQ ID NO: 86492 - DNA, 80 bp, Human herpesvirus 6
tgatctcacgtcacagttttttttttcatatgtctcgcgttgatacatcccgtatgaaatatttaaggtggttgaaatca

SEQ ID NO: 86493 - DNA, 24 bp, Human herpesvirus 6
tctcacgtcacagttttttttttc

SEQ ID NO: 86494 - DNA, 18 bp, Homo sapiens
catcacagttgttttttt

SEQ ID NO: 86495 - DNA, 22 bp, Homo sapiens
tcttgagtcacatttttttttt

SEQ ID NO: 86496 - DNA, 20 bp, Homo sapiens
ctcacaaaagtttttttttt

SEQ ID NO: 86497 - DNA, 24 bp, Homo sapiens
tcgcgtttacagattttttttttc

SEQ ID NO: 86498 - DNA, 23 bp, Homo sapiens
tctcccggacctgtttttttttt

SEQ ID NO: 86499 - DNA, 20 bp, Homo sapiens
gtcacagtgcattttttttt

SEQ ID NO: 86500 - DNA, 23 bp, Homo sapiens
tctcacattagcatttttttttt

SEQ ID NO: 86501 - DNA, 20 bp, Homo sapiens
tctacaacagtttttttttt

SEQ ID NO: 86502 - DNA, 25 bp, Homo sapiens
tcacatacacgaagttttttttttc

SEQ ID NO: 86503 - DNA, 23 bp, Homo sapiens
tcacttttactgttttttttttc

SEQ ID NO: 86504 - DNA, 23 bp, Homo sapiens
tcactttgccagttttttttttc

SEQ ID NO: 86505 - DNA, 21 bp, Homo sapiens
tcagttcacagtttttttttt

SEQ ID NO: 86506 - DNA, 21 bp, Homo sapiens
tcacatgacgttttttttttc

SEQ ID NO: 86507 - DNA, 20 bp, Homo sapiens
tcactcctggtttttttttt

SEQ ID NO: 86508 - DNA, 21 bp, Homo sapiens
gccaggcaggttttttttttc

SEQ ID NO: 86509 - DNA, 21 bp, Homo sapiens
tcacagaatgttttttttttc

SEQ ID NO: 86510 - DNA, 21 bp, Homo sapiens
tctctacgttgcaggtttttt

SEQ ID NO: 86511 - DNA, 23 bp, Homo sapiens
tctcaggttccaatttttttttt

SEQ ID NO: 86512 - DNA, 23 bp, Homo sapiens
tcccacgtccttgtttttttttt

SEQ ID NO: 86513 - DNA, 20 bp, Homo sapiens
tcaacaacagtttttttttt

SEQ ID NO: 86514 - DNA, 19 bp, Homo sapiens
tcttacgtccatgtttttc

SEQ ID NO: 86515 - DNA, 19 bp, Homo sapiens
tctcccgtctttttttttt

SEQ ID NO: 86516 - DNA, 18 bp, Homo sapiens
tcatctcacagccttttt

SEQ ID NO: 86517 - DNA, 20 bp, Homo sapiens
tcacttcacttttttttttt

SEQ ID NO: 86518 - DNA, 22 bp, Homo sapiens
cgctctgacagttttttttttc

SEQ ID NO: 86519 - DNA, 16 bp, Homo sapiens
tctcacgccttttttt

SEQ ID NO: 86520 - DNA, 21 bp, Homo sapiens
tctcattcacagttcgacttc

SEQ ID NO: 86521 - DNA, 20 bp, Homo sapiens
tcatgtcacaagggtttttc

SEQ ID NO: 86522 - DNA, 20 bp, Homo sapiens
ccacgtttatgttttttttc

SEQ ID NO: 86523 - DNA, 20 bp, Homo sapiens
tcagtcgtgttctttttttc

SEQ ID NO: 86524 - DNA, 23 bp, Homo sapiens
tctcaggtcacagtacttttttc

SEQ ID NO: 86525 - DNA, 18 bp, Homo sapiens
catcttcagttttttttc

SEQ ID NO: 86526 - DNA, 20 bp, Homo sapiens
tctcagttcaattttttttt

SEQ ID NO: 86527 - DNA, 19 bp, Homo sapiens
gccacaaggtttttttttt

SEQ ID NO: 86528 - DNA, 19 bp, Homo sapiens
tctcacgttacattatttc

SEQ ID NO: 86529 - DNA, 18 bp, Homo sapiens
gctgcagttttttttttc

SEQ ID NO: 86530 - DNA, 79 bp, Human herpesvirus 6B
tgatctcacgtcacagtttttttttcatatgtctcgcgttgatacatcccgtatgaaatatttaaggtggttgaaatca

SEQ ID NO: 86531 - DNA, 24 bp, Human herpesvirus 6B
tctcacgtcacagtttttttttca

SEQ ID NO: 86532 - DNA, 20 bp, Homo sapiens
tctcagttgtcagctttttt

SEQ ID NO: 86533 - DNA, 17 bp, Homo sapiens
tccgtcatggttttcct

SEQ ID NO: 86534 - DNA, 18 bp, Homo sapiens
gtccacaggttttttttt

SEQ ID NO: 86535 - DNA, 23 bp, Homo sapiens
gtcacagtgcatttttttttttc

SEQ ID NO: 86536 - DNA, 22 bp, Homo sapiens
tctccgtcacagttggagatca

SEQ ID NO: 86537 - DNA, 19 bp, Homo sapiens
tcttacatcacaagttttt

SEQ ID NO: 86538 - DNA, 21 bp, Homo sapiens
tcactttgccagttttttttt

SEQ ID NO: 86539 - DNA, 22 bp, Homo sapiens
tcacatgacgttttttttttca

SEQ ID NO: 86540 - DNA, 22 bp, Homo sapiens
tcttacgttgaagtttttttct

SEQ ID NO: 86541 - DNA, 17 bp, Homo sapiens
tctcagttacagttctt

SEQ ID NO: 86542 - DNA, 17 bp, Homo sapiens
tctcattcacagtgttt

SEQ ID NO: 86543 - DNA, 22 bp, Homo sapiens
tctcaggttccaattttttttt

SEQ ID NO: 86544 - DNA, 22 bp, Homo sapiens
tctcccgtcttttttttttttt

SEQ ID NO: 86545 - DNA, 23 bp, Homo sapiens
tctacacatagaggttttttttt

SEQ ID NO: 86546 - DNA, 22 bp, Homo sapiens
tcacttcacttttttttttttc

SEQ ID NO: 86547 - DNA, 19 bp, Homo sapiens
tcacatcgacttttttttt

SEQ ID NO: 86548 - DNA, 19 bp, Homo sapiens
tcccatgtatttttttttc

SEQ ID NO: 86549 - DNA, 19 bp, Homo sapiens
tctcagctttttttttttc

SEQ ID NO: 86550 - DNA, 19 bp, Homo sapiens
tctcactttcctttttttc

SEQ ID NO: 86551 - DNA, 19 bp, Homo sapiens
tcatgtttcagtttttctc

SEQ ID NO: 86552 - DNA, 73 bp, West Nile virus
tagttcgcctgtgtgagctgacaaacttagtagtgtttgtgaggattaacaacaattaacacagtgcgagctg

SEQ ID NO: 86553 - DNA, 17 bp, West Nile virus
taacacagtgcgagctg

SEQ ID NO: 86554 - DNA, 19 bp, Homo sapiens
caacacagactccgagctg

SEQ ID NO: 86555 - DNA, 18 bp, Homo sapiens
caacacaatgaaaagctg

SEQ ID NO: 86556 - DNA, 19 bp, Homo sapiens
taacacaagccaagggctg

SEQ ID NO: 86557 - DNA, 18 bp, Homo sapiens
taacacagtgaaatcctg

SEQ ID NO: 86558 - DNA, 18 bp, Homo sapiens
caacacagtccggggctg

SEQ ID NO: 86559 - DNA, 20 bp, Homo sapiens
caacacagccagaagagctg

SEQ ID NO: 86560 - DNA, 18 bp, Homo sapiens
caacacagcaaaatgctg

SEQ ID NO: 86561 - DNA, 19 bp, Homo sapiens
aacacagtggcgcaggctg

SEQ ID NO: 86562 - DNA, 19 bp, Homo sapiens
taacacagtcccaatgctg

SEQ ID NO: 86563 - DNA, 19 bp, Homo sapiens
taacacagcttaccaactg

SEQ ID NO: 86564 - DNA, 18 bp, Homo sapiens
taacacaggtgataactg

SEQ ID NO: 86565 - DNA, 18 bp, Homo sapiens
caacacagtaaaatcctg

SEQ ID NO: 86566 - DNA, 19 bp, Homo sapiens
taacacagtcaactagctg

SEQ ID NO: 86567 - DNA, 69 bp, Molluscum contagiosum virus
ggcggcaagcgagatccctccgagacgtctggctcgtactgctgcaggcaaagcggggcgcgcgccgct

SEQ ID NO: 86568 - DNA, 24 bp, Molluscum contagiosum virus
aggcaaagcggggcgcgcgccgct

SEQ ID NO: 86569 - DNA, 21 bp, Homo sapiens
ggcagggtggaggcgctgcgc

SEQ ID NO: 86570 - DNA, 18 bp, Homo sapiens
gcggggcgcgcgcgcgcc

SEQ ID NO: 86571 - DNA, 22 bp, Homo sapiens
ggcagagcggagcggggctgct

SEQ ID NO: 86572 - DNA, 19 bp, Homo sapiens
aggcggagcggggcgctcg

SEQ ID NO: 86573 - DNA, 19 bp, Homo sapiens
gcgaggcgcgggcgctgct

SEQ ID NO: 86574 - DNA, 20 bp, Homo sapiens
ggcaggctggggagaccgct

SEQ ID NO: 86575 - DNA, 22 bp, Homo sapiens
ggccagggcccggcgcgctgct

SEQ ID NO: 86576 - DNA, 21 bp, Homo sapiens
aggcagggcgggagtgcgggc

SEQ ID NO: 86577 - DNA, 18 bp, Homo sapiens
gctggagcgctgcgccgc

SEQ ID NO: 86578 - DNA, 21 bp, Homo sapiens
aggcggagcgcggtgcagacc

SEQ ID NO: 86579 - DNA, 26 bp, Homo sapiens
aggcggggcgggccgtggcacctgct

SEQ ID NO: 86580 - DNA, 19 bp, Homo sapiens
gcggggcgctcgcgccgct

SEQ ID NO: 86581 - DNA, 18 bp, Homo sapiens
ggcggagcgggggcgcgc

SEQ ID NO: 86582 - DNA, 18 bp, Homo sapiens
agcagagcactgcgttgc

SEQ ID NO: 86583 - DNA, 18 bp, Homo sapiens
ggcagaggggggcgcgcg

SEQ ID NO: 86584 - DNA, 26 bp, Homo sapiens
aggcagggcggcgcgcggcgtccgct

SEQ ID NO: 86585 - DNA, 21 bp, Homo sapiens
gcggggcgggcgcccgtggct

SEQ ID NO: 86586 - DNA, 24 bp, Homo sapiens
aggcggggcggggcggggcggact

SEQ ID NO: 86587 - DNA, 17 bp, Homo sapiens
ggccagggtcgcgccgc

SEQ ID NO: 86588 - DNA, 21 bp, Homo sapiens
ggcggggcggggcggggcgcc

SEQ ID NO: 86589 - DNA, 21 bp, Homo sapiens
agcgcggagcgggtggctgct

SEQ ID NO: 86590 - DNA, 21 bp, Homo sapiens
ggcaggccggggcgcggggct

SEQ ID NO: 86591 - DNA, 23 bp, Homo sapiens
ggcggagtggcaacaacgccgct

SEQ ID NO: 86592 - DNA, 18 bp, Homo sapiens
gcagggcgagcacaggct

SEQ ID NO: 86593 - DNA, 20 bp, Homo sapiens
aagcggggtggggcgcatcc

SEQ ID NO: 86594 - DNA, 22 bp, Homo sapiens
ggctaaggcggggaacaccgct

SEQ ID NO: 86595 - DNA, 24 bp, Homo sapiens
aggcgcaggcggggcccccctgct

SEQ ID NO: 86596 - DNA, 24 bp, Homo sapiens
gggcggggcggtgtaggcgctgct

SEQ ID NO: 86597 - DNA, 22 bp, Homo sapiens
aggcagaagcgcagtagtgccg

SEQ ID NO: 86598 - DNA, 21 bp, Homo sapiens
aggcgggacggggcgcgggcc

SEQ ID NO: 86599 - DNA, 20 bp, Homo sapiens
ggcggagggggcgcatggct

SEQ ID NO: 86600 - DNA, 18 bp, Homo sapiens
ggcggagcggggcgctcc

SEQ ID NO: 86601 - DNA, 22 bp, Homo sapiens
ggccgggaccgcgcgcgccgct

SEQ ID NO: 86602 - DNA, 26 bp, Homo sapiens
aggcaaggcgggggtctagcggcgcg

SEQ ID NO: 86603 - DNA, 23 bp, Homo sapiens
ggcggagcgcggcgcgtggggct

SEQ ID NO: 86604 - DNA, 21 bp, Homo sapiens
aggcgcagcacccgcgccgct

SEQ ID NO: 86605 - DNA, 18 bp, Homo sapiens
aggcaggtggggcgcgcc

SEQ ID NO: 86606 - DNA, 20 bp, Homo sapiens
ggcggcgcggggcgcggccg

SEQ ID NO: 86607 - DNA, 28 bp, Homo sapiens
ggcggggcggggtggggtagcggcgcgc

SEQ ID NO: 86608 - DNA, 20 bp, Homo sapiens
ggcggagccgggcgcgcccg

SEQ ID NO: 86609 - DNA, 26 bp, Homo sapiens
aggcagggcggggccctagcggcgcg

SEQ ID NO: 86610 - DNA, 20 bp, Homo sapiens
gcgggtcgactggcgccgct

SEQ ID NO: 86611 - DNA, 17 bp, Homo sapiens
agccagctgggcgcgcg

SEQ ID NO: 86612 - DNA, 23 bp, Homo sapiens
ggcagagcggggccgtgggggcc

SEQ ID NO: 86613 - DNA, 23 bp, Homo sapiens
aggcgcgggcgggctccgccgct

SEQ ID NO: 86614 - DNA, 21 bp, Homo sapiens
ggcggggcggggcggccggct

SEQ ID NO: 86615 - DNA, 23 bp, Homo sapiens
ggcaaagctgggcagctattgct

SEQ ID NO: 86616 - DNA, 18 bp, Homo sapiens
ggcggagcgaggcgcggc

SEQ ID NO: 86617 - DNA, 21 bp, Homo sapiens
ggccgggcggggggccctgct

SEQ ID NO: 86618 - DNA, 22 bp, Homo sapiens
agcgaggattgtgcgcgccgct

SEQ ID NO: 86619 - DNA, 18 bp, Homo sapiens
ggcagggcgaggctgcgc

SEQ ID NO: 86620 - DNA, 18 bp, Homo sapiens
ggaaaggtggggcgcgcg

SEQ ID NO: 86621 - DNA, 21 bp, Homo sapiens
aggaaagcgggaccagccgct

SEQ ID NO: 86622 - DNA, 17 bp, Homo sapiens
aggcgaacggggcgtcc

SEQ ID NO: 86623 - DNA, 21 bp, Homo sapiens
ggccagagccaggcgcgctgc

SEQ ID NO: 86624 - DNA, 17 bp, Homo sapiens
aggcggagcggggcggc

SEQ ID NO: 86625 - DNA, 22 bp, Homo sapiens
ggcggagcgcggcgtgcgcgct

SEQ ID NO: 86626 - DNA, 19 bp, Homo sapiens
gcggatttaacgcgccgct

SEQ ID NO: 86627 - DNA, 24 bp, Homo sapiens
aggcggcggcgggcggcggccgct

SEQ ID NO: 86628 - DNA, 26 bp, Homo sapiens
ggtgaagcggggctcctagcggcgcg

SEQ ID NO: 86629 - DNA, 18 bp, Homo sapiens
ggagcggagctgcgccgc

SEQ ID NO: 86630 - DNA, 26 bp, Homo sapiens
ggcgcggagcggggcggggcgtcgct

SEQ ID NO: 86631 - DNA, 22 bp, Homo sapiens
agcgaggcggggtgcacggtct

SEQ ID NO: 86632 - DNA, 24 bp, Homo sapiens
aggcgcgggagcttgcgtgctgct

SEQ ID NO: 86633 - DNA, 23 bp, Homo sapiens
agtaacagctcgcgcgcgctgct

SEQ ID NO: 86634 - DNA, 19 bp, Homo sapiens
aggctgggcggggcgcgcg

SEQ ID NO: 86635 - DNA, 19 bp, Homo sapiens
aggcagagctggggtgacg

SEQ ID NO: 86636 - DNA, 22 bp, Homo sapiens
ggccggagcggggcgggcggct

SEQ ID NO: 86637 - DNA, 20 bp, Homo sapiens
ggcgaggcggggcggggcgc

SEQ ID NO: 86638 - DNA, 19 bp, Homo sapiens
aggcggggcggggcgctca

SEQ ID NO: 86639 - DNA, 20 bp, Homo sapiens
ggcagcggcggcctccgccg

SEQ ID NO: 86640 - DNA, 28 bp, Homo sapiens
ggcacaggtggggtgtctagcggcgcgc

SEQ ID NO: 86641 - DNA, 18 bp, Homo sapiens
ggcagagcggggcgcgca

SEQ ID NO: 86642 - DNA, 75 bp, Ovine adenovirus 7
tgactttctggaaatggatttctgcaaatagaaggatctatctttacaacatcatttttccaatttaatgtgtca

SEQ ID NO: 86643 - DNA, 24 bp, Ovine adenovirus 7
tggaaatggatttctgcaaataga

SEQ ID NO: 86644 - DNA, 18 bp, Homo sapiens
tagaaatggctgtaaatg

SEQ ID NO: 86645 - DNA, 23 bp, Homo sapiens
tggtaaattatactgcaaatgga

SEQ ID NO: 86646 - DNA, 21 bp, Homo sapiens
tggagataccctgcaagtaga

SEQ ID NO: 86647 - DNA, 18 bp, Homo sapiens
tggagatgggttcctgca

SEQ ID NO: 86648 - DNA, 21 bp, Homo sapiens
tggaactccactgcaaatgga

SEQ ID NO: 86649 - DNA, 23 bp, Homo sapiens
tggaaatggattttcttcataga

SEQ ID NO: 86650 - DNA, 18 bp, Homo sapiens
tggggactgtccctgcaa

SEQ ID NO: 86651 - DNA, 16 bp, Homo sapiens
tggaaatgtacaagta

SEQ ID NO: 86652 - DNA, 23 bp, Homo sapiens
ggaggtggatttctttctctaaa

SEQ ID NO: 86653 - DNA, 19 bp, Homo sapiens
tgggaatggacttctgtca

SEQ ID NO: 86654 - DNA, 18 bp, Homo sapiens
gaaatggataacggatag

SEQ ID NO: 86655 - DNA, 19 bp, Homo sapiens
ggtggatttctgaactcag

SEQ ID NO: 86656 - DNA, 21 bp, Homo sapiens
gatttcctttctgcaaatgga

SEQ ID NO: 86657 - DNA, 18 bp, Homo sapiens
tgggaatgtatttctgca

SEQ ID NO: 86658 - DNA, 18 bp, Homo sapiens
tgggaatggatttctggc

SEQ ID NO: 86659 - DNA, 18 bp, Homo sapiens
tagggatggatttctgca

SEQ ID NO: 86660 - DNA, 22 bp, Homo sapiens
tggaagtagatttcttcccaga

SEQ ID NO: 86661 - DNA, 66 bp, Murray Valley encephalitis virus
gttcatctgcgtgagcttccgatctcagtattgtttggaaggatcattgattaacgcggtttgaac

SEQ ID NO: 86662 - DNA, 24 bp, Murray Valley encephalitis virus
aaggatcattgattaacgcggttt

SEQ ID NO: 86663 - DNA, 21 bp, Homo sapiens
aaggatcatttattaaacaca

SEQ ID NO: 86664 - DNA, 18 bp, Homo sapiens
aaggattattgatcaacg

SEQ ID NO: 86665 - DNA, 23 bp, Homo sapiens
aaggagcgggcgcagcgcggttt

SEQ ID NO: 86666 - DNA, 18 bp, Homo sapiens
aggttgttgatcgcggtt

SEQ ID NO: 86667 - DNA, 70 bp, Sonchus yellow net virus
tatgtaatattgtgggacatgtgttgtgtgtcatataagaaaaaccaacagatttaagtgattttatata

SEQ ID NO: 86668 - DNA, 24 bp, Sonchus yellow net virus
tgtaatattgtgggacatgtgttg

SEQ ID NO: 86669 - DNA, 19 bp, Homo sapiens
tgcgtggaggtatgtgttg

SEQ ID NO: 86670 - DNA, 23 bp, Homo sapiens
tgtgtgtgtgtgtgtatgtgttg

SEQ ID NO: 86671 - DNA, 23 bp, Homo sapiens
tgggatattgtggggctctgttg

SEQ ID NO: 86672 - DNA, 22 bp, Homo sapiens
gtgatgttatttacatgtgttg

SEQ ID NO: 86673 - DNA, 21 bp, Homo sapiens
tgtatatttaggtatgtgttg

SEQ ID NO: 86674 - DNA, 93 bp, Human herpesvirus 5
gtcaaaagaggccgccagctagacaccccagaaaagaagcagagaaagagacttctttgtgcgacacgttttattctgcgtcctccgctcgac

SEQ ID NO: 86675 - DNA, 24 bp, Human herpesvirus 5
tttgtgcgacacgttttattctgc

SEQ ID NO: 86676 - DNA, 22 bp, Homo sapiens
tgtagtacatgttttattctgc

SEQ ID NO: 86677 - DNA, 22 bp, Homo sapiens
tctgtatgttgttttattctgc

SEQ ID NO: 86678 - DNA, 18 bp, Homo sapiens
caacatgttttattttgc

SEQ ID NO: 86679 - DNA, 25 bp, Homo sapiens
tctgtgcgttgtgcttttgttctgc

SEQ ID NO: 86680 - DNA, 21 bp, Homo sapiens
tttgtggatgtttcattttgc

SEQ ID NO: 86681 - DNA, 71 bp, Cowpox virus
ttttattgagtggtggtagttacggatatctaatattaatattagactatctctatcgtcacacaacaaaa

SEQ ID NO: 86682 - DNA, 24 bp, Cowpox virus
tattgagtggtggtagttacggat

SEQ ID NO: 86683 - DNA, 16 bp, Homo sapiens
ttggtggtggtggtgg

SEQ ID NO: 86684 - DNA, 16 bp, Homo sapiens
tgagtggtggtggtgg

SEQ ID NO: 86685 - DNA, 20 bp, Homo sapiens
gtggctgggtagttacggat

SEQ ID NO: 86686 - DNA, 16 bp, Homo sapiens
ctgagtggcattatgg

SEQ ID NO: 86687 - DNA, 21 bp, Homo sapiens
tattgagttgtggtgcagtgg

SEQ ID NO: 86688 - DNA, 16 bp, Homo sapiens
ttggtggtggtggcgg

SEQ ID NO: 86689 - DNA, 16 bp, Homo sapiens
ttgggtggggagtgga

SEQ ID NO: 86690 - DNA, 60 bp, Human herpesvirus 5
gaacgcacgtgaagttccacagagccgcgtggctgtagctattgtgtttacgttgctttt

SEQ ID NO: 86691 - DNA, 21 bp, Human herpesvirus 5
tattgtgtttacgttgctttt

SEQ ID NO: 86692 - DNA, 18 bp, Homo sapiens
ttgtgtttgcgtctcttt

SEQ ID NO: 86693 - DNA, 19 bp, Homo sapiens
ttgtgtttattctactttt

SEQ ID NO: 86694 - DNA, 19 bp, Homo sapiens
tgttgctgtcgttgctttt

SEQ ID NO: 86695 - DNA, 21 bp, Homo sapiens
tgtgtttgcatttatgctttt

SEQ ID NO: 86696 - DNA, 20 bp, Homo sapiens
cattgtgtttgatggctttt

SEQ ID NO: 86697 - DNA, 19 bp, Homo sapiens
tattgtgtatgtcacttct

SEQ ID NO: 86698 - DNA, 21 bp, Homo sapiens
tgtgtttacctgttggctttt

SEQ ID NO: 86699 - DNA, 20 bp, Homo sapiens
tgtgcaaacttgttgctttt

SEQ ID NO: 86700 - DNA, 17 bp, Homo sapiens
ttgtgttttttgctttt

SEQ ID NO: 86701 - DNA, 17 bp, Homo sapiens
tgtgtttagatactttt

SEQ ID NO: 86702 - DNA, 17 bp, Homo sapiens
ctgtgtcctgtgctttt

SEQ ID NO: 86703 - DNA, 21 bp, Homo sapiens
tatttaccatacgttgctttt

SEQ ID NO: 86704 - DNA, 18 bp, Homo sapiens
ttgtgtttcatgaccttt

SEQ ID NO: 86705 - DNA, 20 bp, Homo sapiens
tattgtctttccatgctttt

SEQ ID NO: 86706 - DNA, 19 bp, Homo sapiens
tatgctctatgttgctttt

SEQ ID NO: 86707 - DNA, 18 bp, Homo sapiens
tactgtgcttttgctttt

SEQ ID NO: 86708 - DNA, 18 bp, Homo sapiens
ttggcttgcgttgctttt

SEQ ID NO: 86709 - DNA, 16 bp, Homo sapiens
tgtgtccagtgctttt

SEQ ID NO: 86710 - DNA, 17 bp, Homo sapiens
tattggtttgctgcttt

SEQ ID NO: 86711 - DNA, 17 bp, Homo sapiens
ttgtgtttacaactttt

SEQ ID NO: 86712 - DNA, 18 bp, Homo sapiens
ttgtgttcccaggctttt

SEQ ID NO: 86713 - DNA, 21 bp, Homo sapiens
tattggtctgaggttgctttt

SEQ ID NO: 86714 - DNA, 17 bp, Homo sapiens
ttgtgttttgcgctttt

SEQ ID NO: 86715 - DNA, 16 bp, Homo sapiens
tgtgtttaatgctttt

SEQ ID NO: 86716 - DNA, 16 bp, Homo sapiens
ttgtgccattgctttt

SEQ ID NO: 86717 - DNA, 68 bp, Human herpesvirus 3
taaaaacgtttctggtgtatgtttttattttgtatataaaattaaaacattgctggctggcgtggtta

SEQ ID NO: 86718 - DNA, 24 bp, Human herpesvirus 3
ttaaaacattgctggctggcgtgg

SEQ ID NO: 86719 - DNA, 24 bp, Homo sapiens
ttaaaacatgctggtcaaatatgg

SEQ ID NO: 86720 - DNA, 18 bp, Homo sapiens
ctaaaatattgctggctg

SEQ ID NO: 86721 - DNA, 71 bp, Human herpesvirus 5
cggtgcacaggaaagagccaaagtgtcacggcgtctttttttatttgtattcctttcctgttttgtactcg

SEQ ID NO: 86722 - DNA, 24 bp, Human herpesvirus 5
tattcctttcctgttttgtactcg

SEQ ID NO: 86723 - DNA, 18 bp, Homo sapiens
ttcctttcagtctgtact

SEQ ID NO: 86724 - DNA, 20 bp, Homo sapiens
tattcctttttgtgcttact

SEQ ID NO: 86725 - DNA, 18 bp, Homo sapiens
tcctttcctgcccttgta

SEQ ID NO: 86726 - DNA, 81 bp, Influenza B virus
ggaaatgtctatggggttattggtcatcgttgaatacatgcggtgcacaaatgattaaaatgaaaaaaggctcgtgtttct

SEQ ID NO: 86727 - DNA, 24 bp, Influenza B virus
ggtgcacaaatgattaaaatgaaa

SEQ ID NO: 86728 - DNA, 26 bp, Homo sapiens
ggttacaaatgattggcttactgaaa

SEQ ID NO: 86729 - DNA, 18 bp, Homo sapiens
ggtgtcacagcaaaatga

SEQ ID NO: 86730 - DNA, 18 bp, Homo sapiens
ggtcacaatataaaatga

SEQ ID NO: 86731 - DNA, 19 bp, Homo sapiens
ggtcacaatttaaaatgaa

SEQ ID NO: 86732 - DNA, 15 bp, Homo sapiens
gtgcatgaaaaatga

SEQ ID NO: 86733 - DNA, 21 bp, Homo sapiens
ggtgcacaggagatcttttga

SEQ ID NO: 86734 - DNA, 20 bp, Homo sapiens
ggtgacacaagtgagaaatg

SEQ ID NO: 86735 - DNA, 18 bp, Homo sapiens
ggtccacaaatggatgaa

SEQ ID NO: 86736 - DNA, 16 bp, Homo sapiens
ggtcacaaaaaaatga

SEQ ID NO: 86737 - DNA, 19 bp, Homo sapiens
ggtacaaatgatttatgaa

SEQ ID NO: 86738 - DNA, 19 bp, Homo sapiens
gtgcacaaatactaagatg

SEQ ID NO: 86739 - DNA, 22 bp, Homo sapiens
ggtacacagagacataaagatg

SEQ ID NO: 86740 - DNA, 20 bp, Homo sapiens
ggtgcacacggtgacccctg

SEQ ID NO: 86741 - DNA, 17 bp, Homo sapiens
agtgtacaaatgaaatg

SEQ ID NO: 86742 - DNA, 21 bp, Homo sapiens
ggtgtggatgaccaaaagtga

SEQ ID NO: 86743 - DNA, 21 bp, Homo sapiens
agtgcacaaagcacagatgaa

SEQ ID NO: 86744 - DNA, 20 bp, Homo sapiens
agtgcacaggtaacagtgaa

SEQ ID NO: 86745 - DNA, 19 bp, Homo sapiens
ggtacaaataaaaaatgaa

SEQ ID NO: 86746 - DNA, 19 bp, Homo sapiens
ggtgccgtggaaaaatgaa

SEQ ID NO: 86747 - DNA, 19 bp, Homo sapiens
agtgtacaaacaaaatgaa

SEQ ID NO: 86748 - DNA, 17 bp, Homo sapiens
ggtgcccttaaaatgaa

SEQ ID NO: 86749 - DNA, 18 bp, Homo sapiens
gattgatgattaaaatga

SEQ ID NO: 86750 - DNA, 18 bp, Homo sapiens
ggtgcacagaaaaatgaa

SEQ ID NO: 86751 - DNA, 16 bp, Homo sapiens
gtgcacaagaaatgaa

SEQ ID NO: 86752 - DNA, 19 bp, Homo sapiens
ggtccacgttttaaaatga

SEQ ID NO: 86753 - DNA, 20 bp, Homo sapiens
ggtgcacaataaatggtgaa

SEQ ID NO: 86754 - DNA, 78 bp, Vaccinia virus
tttggtcgatgtaaaatttttgtcgataaaaattaaaaaataacttaatttattattgatctcgtgtgtacaaccgaa

SEQ ID NO: 86755 - DNA, 24 bp, Vaccinia virus
tgtaaaatttttgtcgataaaaat

SEQ ID NO: 86756 - DNA, 20 bp, Homo sapiens
tgtaaaatgtttatgataaa

SEQ ID NO: 86757 - DNA, 18 bp, Homo sapiens
tgtaaaatttttggtcaa

SEQ ID NO: 86758 - DNA, 19 bp, Homo sapiens
tgaaaatttttgccacaaa

SEQ ID NO: 86759 - DNA, 21 bp, Homo sapiens
gtaaaattttcttataaaaat

SEQ ID NO: 86760 - DNA, 23 bp, Homo sapiens
tgtaaaatttatgcagataaaaa

SEQ ID NO: 86761 - DNA, 21 bp, Homo sapiens
tgcaaaatttttctcaaaaaa

SEQ ID NO: 86762 - DNA, 85 bp, Equine herpesvirus 4
taaatttctgcgagagcacaccgcacccttacgctggctcggatagctacgaatagcgcatggaattgttgctggcagcttttta

SEQ ID NO: 86763 - DNA, 24 bp, Equine herpesvirus 4
gcgcatggaattgttgctggcagc

SEQ ID NO: 86764 - DNA, 24 bp, Homo sapiens
gcgggtggagtgacgtctggcagc

SEQ ID NO: 86765 - DNA, 20 bp, Homo sapiens
gcagtgtggatgctggtggc

SEQ ID NO: 86766 - DNA, 18 bp, Homo sapiens
tgggatgcccctggcagc

SEQ ID NO: 86767 - DNA, 20 bp, Homo sapiens
gcatagaattgttctctggc

SEQ ID NO: 86768 - DNA, 19 bp, Homo sapiens
gcatggaattgttaacagc

SEQ ID NO: 86769 - DNA, 16 bp, Homo sapiens
catggatggctggcag

SEQ ID NO: 86770 - DNA, 23 bp, Homo sapiens
gcgtctgggcccctgctggcagc

SEQ ID NO: 86771 - DNA, 20 bp, Homo sapiens
tggaattgtatgtaggtagc

SEQ ID NO: 86772 - DNA, 17 bp, Homo sapiens
gctggaattgtcaggag

SEQ ID NO: 86773 - DNA, 19 bp, Homo sapiens
gcgtggaattgttgactgg

SEQ ID NO: 86774 - DNA, 21 bp, Homo sapiens
gcacatgggcaggctggcagc

SEQ ID NO: 86775 - DNA, 20 bp, Homo sapiens
tggagggtgaggctggcagc

SEQ ID NO: 86776 - DNA, 23 bp, Homo sapiens
gcgttggggttaccaagggtagc

SEQ ID NO: 86777 - DNA, 18 bp, Homo sapiens
gcgcacgggacgctggcg

SEQ ID NO: 86778 - DNA, 73 bp, Rat cytomegalovirus
gccgctcggggactgcgcgagacaaaagagaggggacgccggaggggtgggagggcgcaaggaccccgcgcgc

SEQ ID NO: 86779 - DNA, 24 bp, Rat cytomegalovirus
gactgcgcgagacaaaagagaggg

SEQ ID NO: 86780 - DNA, 17 bp, Homo sapiens
tgcggcagagaggaggg

SEQ ID NO: 86781 - DNA, 20 bp, Homo sapiens
ctgggcgggacggagcaggg

SEQ ID NO: 86782 - DNA, 21 bp, Homo sapiens
gactgtccggtgcagagaggg

SEQ ID NO: 86783 - DNA, 15 bp, Homo sapiens
ctgcgcgaagagagg

SEQ ID NO: 86784 - DNA, 19 bp, Homo sapiens
gactgtagaaaaggagagg

SEQ ID NO: 86785 - DNA, 23 bp, Homo sapiens
ctgtcccgaggcaaaagagaggg

SEQ ID NO: 86786 - DNA, 19 bp, Homo sapiens
gacagtgcaagaagagagg

SEQ ID NO: 86787 - DNA, 20 bp, Homo sapiens
ctgtgcctcatgagagaggg

SEQ ID NO: 86788 - DNA, 21 bp, Homo sapiens
gcgcgagacgcacaaagaggg

SEQ ID NO: 86789 - DNA, 17 bp, Homo sapiens
ctgccgcagagagaggg

SEQ ID NO: 86790 - DNA, 20 bp, Homo sapiens
ctgcctgagagaggagaggg

SEQ ID NO: 86791 - DNA, 21 bp, Homo sapiens
gagtgcgtgggatgagaaagg

SEQ ID NO: 86792 - DNA, 17 bp, Homo sapiens
ctgtgcgaggaaagaag

SEQ ID NO: 86793 - DNA, 23 bp, Homo sapiens
gactgcacgaggcgcccccaggg

SEQ ID NO: 86794 - DNA, 21 bp, Homo sapiens
gactacacttaggagggaggg

SEQ ID NO: 86795 - DNA, 21 bp, Homo sapiens
gactgagcgcgcgagagaggg

SEQ ID NO: 86796 - DNA, 15 bp, Homo sapiens
ccgcgcggagagagg

SEQ ID NO: 86797 - DNA, 16 bp, Homo sapiens
gattgcgcgaggagga

SEQ ID NO: 86798 - DNA, 21 bp, Homo sapiens
gactgcagccaggagagaggg

SEQ ID NO: 86799 - DNA, 22 bp, Homo sapiens
ctgccgtggcattaagagaggg

SEQ ID NO: 86800 - DNA, 19 bp, Homo sapiens
ctggtggaagaagagaggg

SEQ ID NO: 86801 - DNA, 19 bp, Homo sapiens
tggcaaggataaaagaggg

SEQ ID NO: 86802 - DNA, 21 bp, Homo sapiens
ctgcggctggaagagagaggg

SEQ ID NO: 86803 - DNA, 16 bp, Homo sapiens
ctgccgggacagagag

SEQ ID NO: 86804 - DNA, 18 bp, Homo sapiens
aactgtgagggagagagg

SEQ ID NO: 86805 - DNA, 23 bp, Homo sapiens
gacgcgcgagatggagcacatgg

SEQ ID NO: 86806 - DNA, 24 bp, Homo sapiens
gctgtctctgggtaaaagagaggg

SEQ ID NO: 86807 - DNA, 16 bp, Homo sapiens
acgagacagaggaggg

SEQ ID NO: 86808 - DNA, 22 bp, Homo sapiens
gataaacagacaaaagggaggg

SEQ ID NO: 86809 - DNA, 26 bp, Homo sapiens
gaccgcacgggaggcgggggggaggg

SEQ ID NO: 86810 - DNA, 20 bp, Homo sapiens
ctgctggagacaagagaggg

SEQ ID NO: 86811 - DNA, 19 bp, Homo sapiens
ctgctgctccaagagaggg

SEQ ID NO: 86812 - DNA, 18 bp, Homo sapiens
gactggcaacagggaggg

SEQ ID NO: 86813 - DNA, 21 bp, Homo sapiens
gctgtcgatcaggagagaggg

SEQ ID NO: 86814 - DNA, 25 bp, Homo sapiens
ctgtggtgggagagaaaggagaggg

SEQ ID NO: 86815 - DNA, 21 bp, Homo sapiens
ctggggaggtggaagagaggg

SEQ ID NO: 86816 - DNA, 20 bp, Homo sapiens
gctggtggacaaaagagggg

SEQ ID NO: 86817 - DNA, 21 bp, Homo sapiens
gactggggagagaggagaggg

SEQ ID NO: 86818 - DNA, 22 bp, Homo sapiens
gactgcgcgggcacagagcagg

SEQ ID NO: 86819 - DNA, 67 bp, African swine fever virus
tattttaatggaactggatcattaggacctctcccgcccatttaaatttttagtttctacaataata

SEQ ID NO: 86820 - DNA, 24 bp, African swine fever virus
tggaactggatcattaggacctct

SEQ ID NO: 86821 - DNA, 19 bp, Homo sapiens
tggaactggattgcttaag

SEQ ID NO: 86822 - DNA, 23 bp, Homo sapiens
tggggctggcatggaggacctct

SEQ ID NO: 86823 - DNA, 21 bp, Homo sapiens
ggggctgggacctggacctct

SEQ ID NO: 86824 - DNA, 22 bp, Homo sapiens
tggaacggatcattaaggacct

SEQ ID NO: 86825 - DNA, 17 bp, Homo sapiens
tggaactagattgacct

SEQ ID NO: 86826 - DNA, 16 bp, Homo sapiens
tggaatggaaggatct

SEQ ID NO: 86827 - DNA, 17 bp, Homo sapiens
tggaactggcaggaccc

SEQ ID NO: 86828 - DNA, 18 bp, Homo sapiens
tgggactcgggggacctc

SEQ ID NO: 86829 - DNA, 20 bp, Homo sapiens
tgcaattggattagaacacc

SEQ ID NO: 86830 - DNA, 21 bp, Homo sapiens
tggaatgggtagaggacctct

SEQ ID NO: 86831 - DNA, 18 bp, Homo sapiens
tggaatgggatcatccct

SEQ ID NO: 86832 - DNA, 21 bp, Homo sapiens
tggaactggggcacagcttct

SEQ ID NO: 86833 - DNA, 21 bp, Homo sapiens
tggaactgagttagaatgtct

SEQ ID NO: 86834 - DNA, 21 bp, Homo sapiens
tgggtcttatctttgggacct

SEQ ID NO: 86835 - DNA, 18 bp, Homo sapiens
tggggtctggaggacctc

SEQ ID NO: 86836 - DNA, 18 bp, Homo sapiens
ggattggctcagacccct

SEQ ID NO: 86837 - DNA, 21 bp, Homo sapiens
tggaactggaacattcaccag

SEQ ID NO: 86838 - DNA, 68 bp, Fowlpox virus
gtttagtgtaataaatttaataaaatattgacaaaatagttaaatgaatatatgaaagtacattatac

SEQ ID NO: 86839 - DNA, 24 bp, Fowlpox virus
ttagtgtaataaatttaataaaat

SEQ ID NO: 86840 - DNA, 18 bp, Homo sapiens
ttagtgtaacaaattcaa

SEQ ID NO: 86841 - DNA, 22 bp, Homo sapiens
ttagtgcaataagtttaaaaaa

SEQ ID NO: 86842 - DNA, 21 bp, Homo sapiens
tagttacaaatttaataaaat

SEQ ID NO: 86843 - DNA, 18 bp, Homo sapiens
agtgtaataaattacaaa

SEQ ID NO: 86844 - DNA, 20 bp, Homo sapiens
ttagtgtaataacttttaca

SEQ ID NO: 86845 - DNA, 19 bp, Homo sapiens
ttagtgttgtaaatttaac

SEQ ID NO: 86846 - DNA, 18 bp, Homo sapiens
ttagtgtaacagaactca

SEQ ID NO: 86847 - DNA, 72 bp, Rat cytomegalovirus
ggcggcgggtccctcttgtctcggagacggcgggtcacgggtatttcacgacgtctcacggtactcgacgcc

SEQ ID NO: 86848 - DNA, 24 bp, Rat cytomegalovirus
tccctcttgtctcggagacggcgg

SEQ ID NO: 86849 - DNA, 20 bp, Homo sapiens
cctcttgctttggaagatgg

SEQ ID NO: 86850 - DNA, 18 bp, Homo sapiens
cttttgtctcagagtagg

SEQ ID NO: 86851 - DNA, 21 bp, Homo sapiens
cctttttgcctcggcagctgg

SEQ ID NO: 86852 - DNA, 20 bp, Homo sapiens
tcttttcccggaggtggtgg

SEQ ID NO: 86853 - DNA, 24 bp, Homo sapiens
tccccctgcaactggggatggcgg

SEQ ID NO: 86854 - DNA, 20 bp, Homo sapiens
ccctcttgtcctcgtggtgg

SEQ ID NO: 86855 - DNA, 24 bp, Homo sapiens
ccctgcagccctcggaggcggcgg

SEQ ID NO: 86856 - DNA, 23 bp, Homo sapiens
tccctctcgccatagggcggcgg

SEQ ID NO: 86857 - DNA, 20 bp, Homo sapiens
tccctcttgtttgtggacag

SEQ ID NO: 86858 - DNA, 24 bp, Homo sapiens
tccctctcccacaggaggcggcgg

SEQ ID NO: 86859 - DNA, 22 bp, Homo sapiens
ctcttcttccccggggcggcgg

SEQ ID NO: 86860 - DNA, 21 bp, Homo sapiens
tccttctggtctcaaaggtgg

SEQ ID NO: 86861 - DNA, 21 bp, Homo sapiens
cttatgcagaggagacggcgg

SEQ ID NO: 86862 - DNA, 24 bp, Homo sapiens
tcttgtccatgtcggaggcggtgg

SEQ ID NO: 86863 - DNA, 20 bp, Homo sapiens
ctctttcccagaggtggcgg

SEQ ID NO: 86864 - DNA, 18 bp, Homo sapiens
tccctctcgtcttggaga

SEQ ID NO: 86865 - DNA, 20 bp, Homo sapiens
tcttatttcaaaaacggtgg

SEQ ID NO: 86866 - DNA, 22 bp, Homo sapiens
tccctcttttcttgggtgctgg

SEQ ID NO: 86867 - DNA, 26 bp, Homo sapiens
tccctgttgttttggaaatgccgcgg

SEQ ID NO: 86868 - DNA, 22 bp, Homo sapiens
tccctcttgctcctcctggcgg

SEQ ID NO: 86869 - DNA, 18 bp, Homo sapiens
tccttcctgtctacggcg

SEQ ID NO: 86870 - DNA, 20 bp, Homo sapiens
cctctcgctggggacggcgg

SEQ ID NO: 86871 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 86872 - DNA, 1262 bp, Homo Sapiens
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 86873 - DNA, 1445 bp, Homo Sapiens
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 86874 - DNA, 42 bp, Homo Sapiens
taatacgactcactatagggtgaggtagtaagttgtattgtt

SEQ ID NO: 86875 - DNA, 41 bp, Homo Sapiens
aattaaccctcactaaagggaaagtagtaagttgtatagtt

SEQ ID NO: 86876 - DNA, 40 bp, Homo Sapiens
taatacgactcactataggcccttattagaggattctgct

SEQ ID NO: 86877 - DNA, 41 bp, Homo Sapiens
aattaaccctcactaaaggtttttttttcctgagacagagt

SEQ ID NO: 86878 - DNA, 20 bp, Homo Sapiens
gaggcaggagaattgcttga

SEQ ID NO: 86879 - DNA, 39 bp, Homo Sapiens
aattaaccctcactaaaggcctgagacagagtcttgctc
